United States Patent
Serino et al.

(10) Patent No.: US 10,988,511 B2
(45) Date of Patent: Apr. 27, 2021

(54) **CONSERVED *ESCHERICHIA* BACTERIAL IG-LIKE DOMAIN (GROUP 1) PROTEIN (ORF405) IMMUNOGENS**

(75) Inventors: Laura Serino, Siena (IT); Maria Rita Fontana, Siena (IT); Danilo Gomes Moriel, Siena (IT)

(73) Assignee: GLAXOSMITHKLINE BIOLOGICALS SA, Rixensart (BE)

( * ) Notice: Subject to any disclaimer, the term of this patent is extended or adjusted under 35 U.S.C. 154(b) by 844 days.

(21) Appl. No.: 13/382,906

(22) PCT Filed: Jul. 7, 2010

(86) PCT No.: PCT/IB2010/001962
§ 371 (c)(1),
(2), (4) Date: May 7, 2012

(87) PCT Pub. No.: WO2011/004263
PCT Pub. Date: Jan. 13, 2011

(65) Prior Publication Data
US 2012/0207776 A1  Aug. 16, 2012

Related U.S. Application Data

(60) Provisional application No. 61/223,664, filed on Jul. 7, 2009, provisional application No. 61/291,140, filed on Dec. 30, 2009.

(51) Int. Cl.
| | | |
|---|---|---|
| *C07K 14/245* | (2006.01) | |
| *A61K 39/108* | (2006.01) | |
| *A61K 39/00* | (2006.01) | |

(52) U.S. Cl.
CPC ........ *C07K 14/245* (2013.01); *A61K 39/0258* (2013.01); *A61K 39/00* (2013.01); *Y02A 50/30* (2018.01)

(58) Field of Classification Search
None
See application file for complete search history.

(56) References Cited

FOREIGN PATENT DOCUMENTS

| | | | |
|---|---|---|---|
| WO | WO-2005/103073 A2 | | 11/2005 |
| WO | 2006/089264 | * | 8/2006 |
| WO | WO-2006/091517 A2 | | 8/2006 |
| WO | 2008020330 | * | 2/2008 |
| WO | WO-2008/020330 A2 | | 2/2008 |

OTHER PUBLICATIONS

GenBank Accession ABK79673, Guo et al, 2006.*
Accession No. B1JOX5, Apr. 28, 2008.*
Accession No. Q3I510, 2005.*
See Harlow et al, Antibodies A Laboratory Manual, Cold Spring Harbor 1988, Chapter 5, pp. 53-137.*
Attwood et al, Science, 290(5491):471-473, 2000.*
Price III et al (Microbial Informatics and Experimentation, 1:6 pages 1-20, 2011).*
Bejar et al. (1986) "Control of cell division in *Escherichia coli*. DNA sequence of dicA and of a second gene complementing mutation dicA1, dicC." Nucleic Acids Research 14(17):6821-6833.
Database UniProt [online]. Database accession No. A1A7T1, submitted Jan. 23, 2007.
Database UniProt [online]. Database accession No. B1XE40, submitted May 20, 2008.
Database UniProt [online]. Database accession No. C2DVG5, submitted Jun. 16, 2009.
Database UniProt [online]. Database accession No. Q0TL97, submitted Sep. 5, 2006.
International Search Report dated Jul. 13, 2011, for PCT/IB2010/001962, 11 pages.
Moriel, Danilo Gomes et al. (May 18, 2010) "Identification of protective and broadly conserved vaccine antigens from the genome of extraintestinal pathogenic *Escherichia coli*," PNAS 107(20):9072-9077.
Kaper et al., "Pathogenic *Escherichia coli*" Nature Reviews Microbiology, vol. 2, Feb. 2004, pp. 123-140.
Smith et al., "Extraintestinal Pathogenic *Escherichia coli*", Foodborne Pathogens and Disease, vol. 4, No. 2, 2007, pp. 134-163.

* cited by examiner

*Primary Examiner* — Patricia Duffy
(74) *Attorney, Agent, or Firm* — Birch, Stewart, Kolasch & Birch, LLP

(57) ABSTRACT

Homologs of the *E. coli* proteins orf353, bacterial lg-like domain (group 1) protein (orf405), flu antigen 43 (orf1 364), NodT-family outer-membrane-factor-lipoprotein efflux transporter (orf1 767), gspK (orf3515), gspJ (orf3516), toriB-dependent siderophore receptor (orO597), fibrial protein (orf3613), upec-948, upec-1232. A chain precursor of the type-1 fimbria! protein (upec-1875), yapH homolog (upec-2820), hemolysin A (recp-3768), and Sel 1 repeat-containing protein (upec-521 1) from several pathogenic strains of *E. coli* have been identified with regions within the proteins that are conserved across all *E. coli*. Fragments corresponding to the conserved regions, especially immunogenic fragments such a linear B-epitopes, are provided. In addition, variants of the bacterial lg-like domain (group 1) protein (orf405), yapH homolog (upec2820) and two different fragments of hemolysin A (recp3768) are provided herein that have increased solubility as compared to the native protein where the variants still raise a substantially similar immune response in a subject as the corresponding native protein.

18 Claims, 14 Drawing Sheets

Specification includes a Sequence Listing.

orf00405

FIGURE 3 orf01364

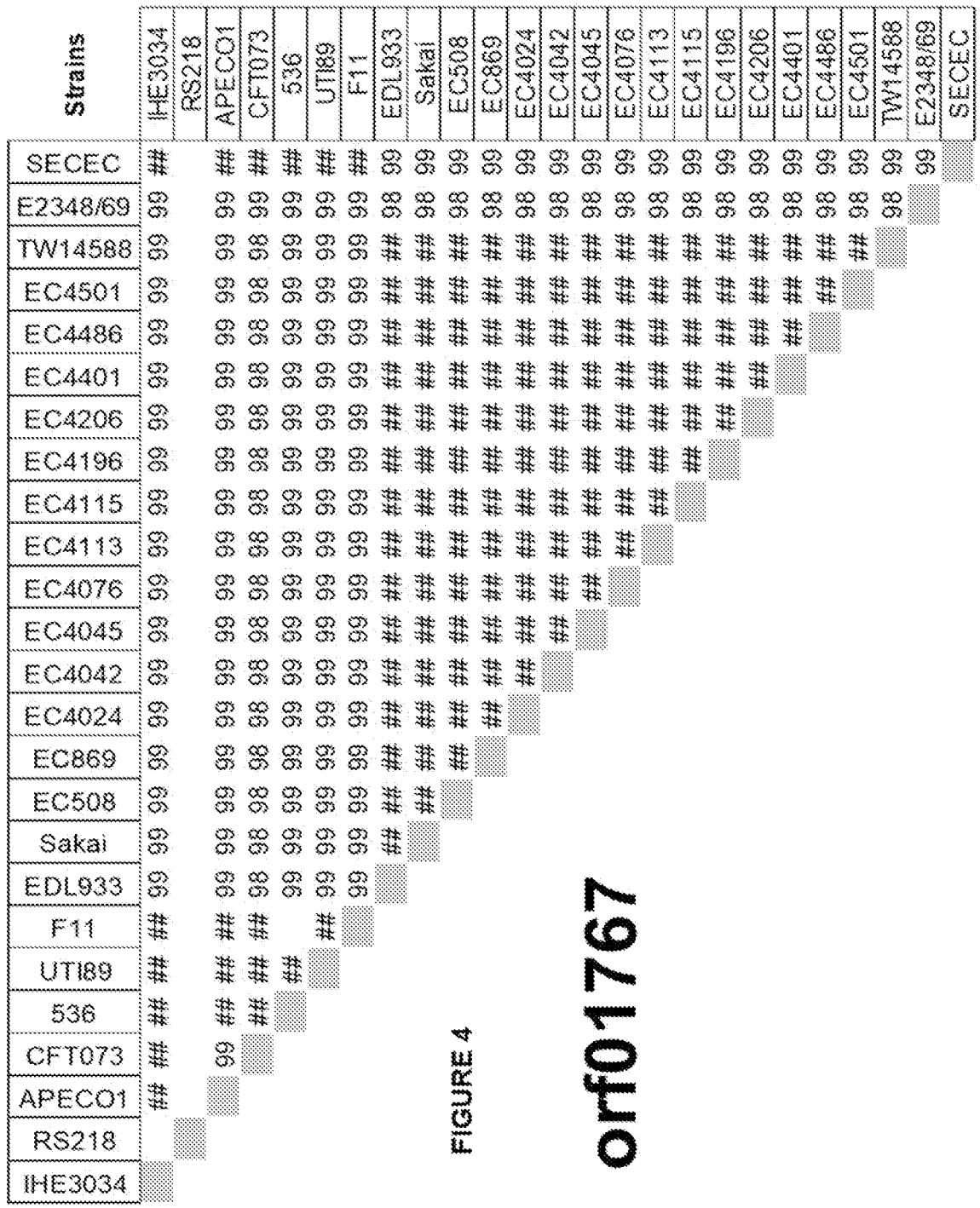
FIGURE 4 orf01767

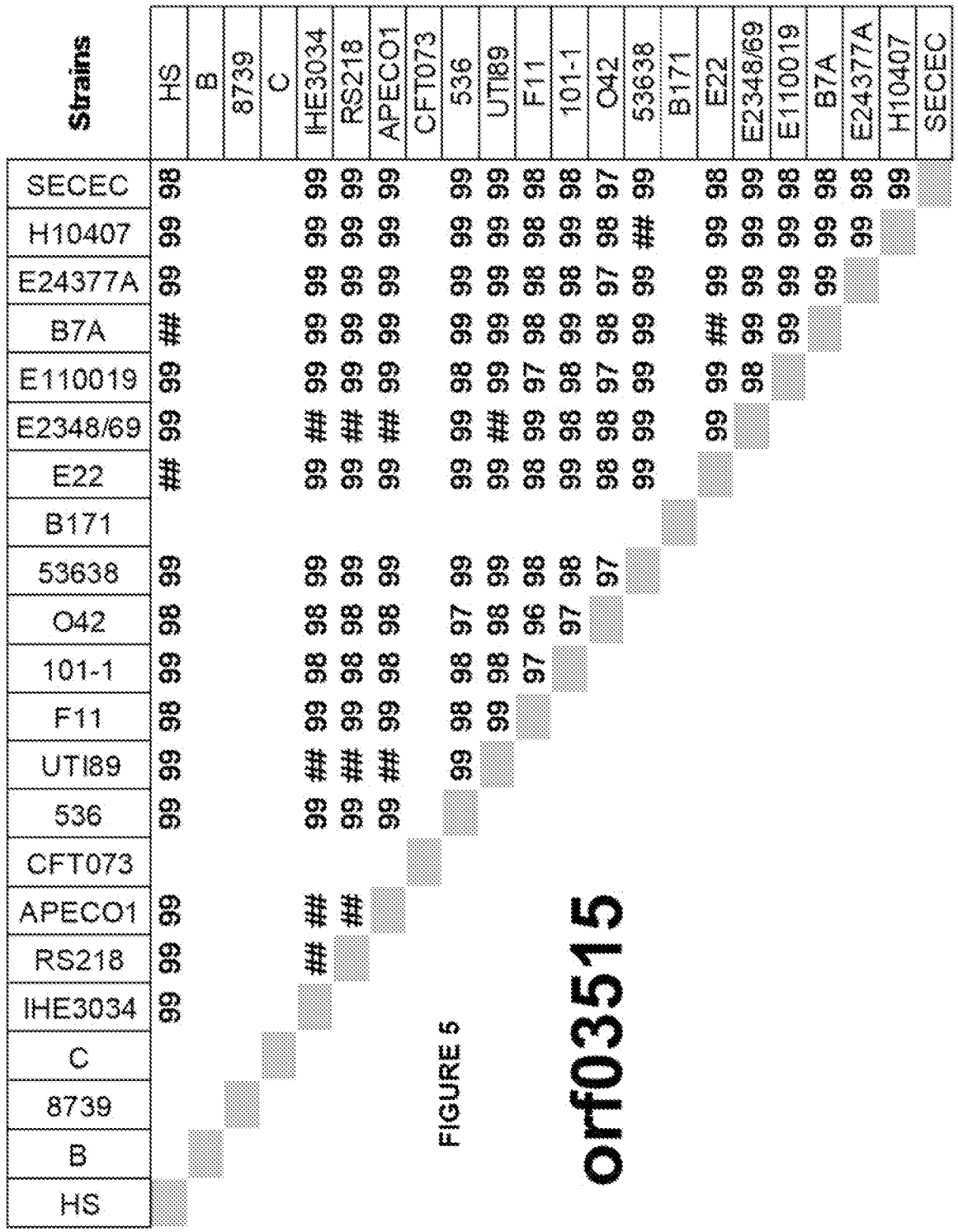
FIGURE 5 orf03515

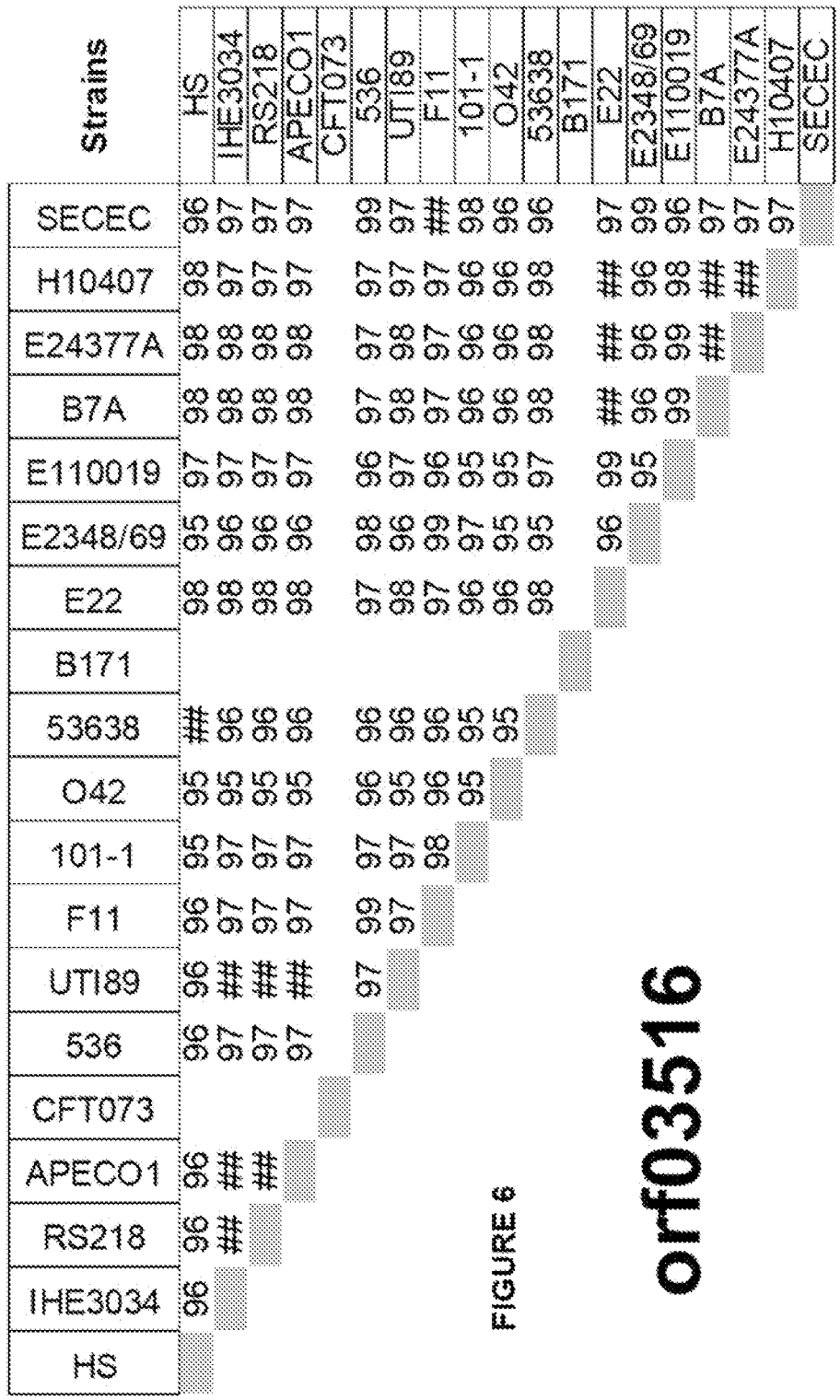
FIGURE 6 orf03516

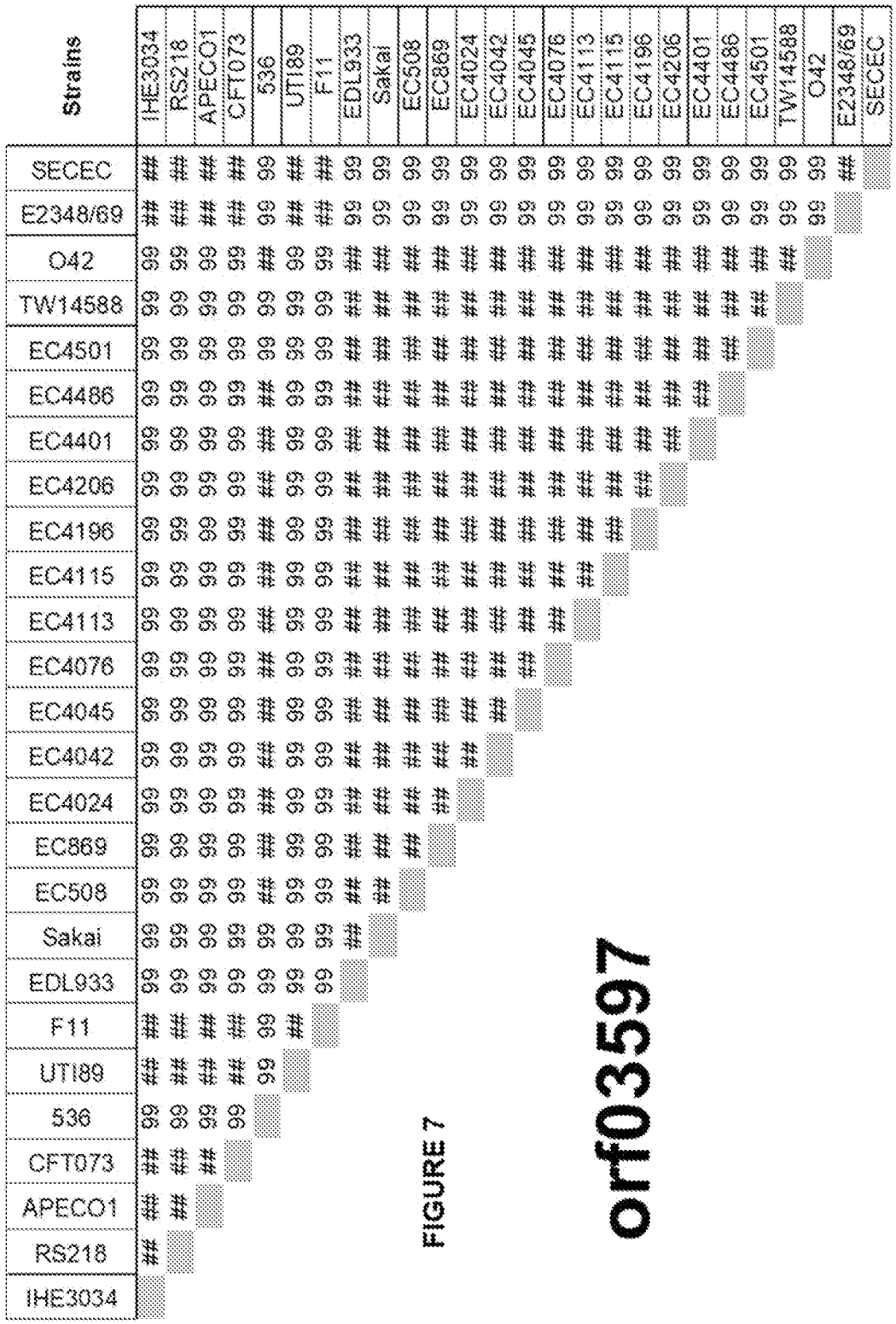
FIGURE 7 orf03597

| Strains | HS | B | C | RS218 | CFT073 | E2348/69 |
|---|---|---|---|---|---|---|
| E2348/69 | 99 | 99 | 99 | ## | ## | |
| CFT073 | 99 | 99 | 99 | ## | | |
| RS218 | 99 | 99 | 99 | | | |
| C | | | | | | |
| B | | | | | | |
| HS | | | | | | | upec-0948

FIGURE 9

| Strains | CFT073 | O42 | B7A | H10407 |
|---|---|---|---|---|
| H10407 | 99 | 99 | 99 | |
| B7A | 99 | ## | | |
| O42 | ## | | | |
| CFT073 | | | | | upec-1232

FIGURE 10

FIGURE 11 upec-1875

FIGURE 12

|  | Strains |  |
|---|---|---|
|  | CFT073 | SECEC |
| upec-2820 | SECEC | 98 |
|  | CFT073 | |

FIGURE 14

CONSERVED *ESCHERICHIA* BACTERIAL IG-LIKE DOMAIN (GROUP 1) PROTEIN (ORF405) IMMUNOGENS

CROSS REFERENCE TO RELATED APPLICATIONS

This application is a U.S. National Phase patent application of PCT/IB2010/001962, filed Jul. 7, 2010, which claims priority to U.S. Provisional patent application Ser. No. 61/223,664 filed Jul. 7, 2009, and U.S. Provisional patent application Ser. No. 61/291,140 filed Dec. 30, 2009, all of which are hereby incorporated by reference in the present disclosure in their entirety.

SUBMISSION OF SEQUENCE LISTING AS ASCII TEXT FILE

The content of the following submission on ASCII text file is incorporated herein by reference in its entirety: a computer readable form (CRF) of the Sequence Listing (file name: 223002109000SeqList.txt, date recorded: Jan. 6, 2012, size: 1077 KB).

TECHNICAL FIELD

This invention relates to immunisation against pathogenic *Escherichia coli* strains.

BACKGROUND ART

*E. coli* strains have traditionally been classified as either commensal or pathogenic, and pathogenic strains are then sub-classified as intestinal or extraintestinal strains. Pathogenic *E. coli* are discussed in more detail in reference 1, and fall into a number of different pathotypes i.e. a group of *E. coli* strains that cause a common disease using a common set of virulence factors. Pathotyping of strains is a routine technique that can be performed genotypically or phenotypically. One recent genotype-based pathotyping method [2] uses a DNA microarray.

Among intestinal strains at least six well-described pathotypes are known: enteropathogenic (EPEC), enterohaemorrhagic (EHEC), enteroaggregative (EAEC), enteroinvasive (EIEC), enterotoxigenic (ETEC) and diffusely adherent (DAEC).

The extraintestinal pathogenic strains (or 'ExPEC' strains [3,4]) of *E. coli* include uropathogenic (UPEC) strains, neonatal meningitis (NMEC) strains, and septicemia-associated strains (SEPEC). ExPEC is the most common cause of urinary tract infections and one of the leading causes of neonatal meningitis and neonatal sepsis in humans, which can lead to serious complications and death. Other types of extraintestinal infections include osteomyelitis, pulmonary, intra-abdominal, soft tissue, and intravascular device-associated infections. Another ExPEC pathotype outside humans is avian pathogenic (APEC), causing extraintestinal infections in poultry.

Most previous ExPEC vaccines have been based on cell lysates or on cellular structures. SOLCOUROVAC™ includes ten different heat-killed bacteria including six ExPEC strains. URO-VAXOM™ is an oral tablet vaccine containing lyophilised bacterial lysates of 18 selected *E. coli* strains. Baxter Vaccines developed a UTI vaccine based on pili from 6 to 10 different strains. MedImmune developed a product called MEDI 516 based on the FimH adhesin complex. In contrast, references 5 and 6 disclose specific immunogens from ExPEC strains that can be used as the basis of defined vaccines against both NMEC and UPEC strains.

However, there remains a need for providing a vaccine that protects against a broad spectrum of intestinal and extraintestinal *E. coli* strains. *E. coli* is a versatile microorganism with an improved ability to adapt to new niches and to cause a broad spectrum of disease. Fitness, virulence and colonization factors can change in order to allow the microorganism to adapt to different tissues and hosts. Therefore, potential antigens are subject to high selective pressure and, as a result, may have sequence variability among different strains.

The database of genomes available at ncbi.nlm.nih.gov under genomes listed twenty one pathogenic and non-pathogenic *E. coli* genomes with as few as 4,126 proteins to as many as 5,339 proteins. However, such listings do not identify which are conserved across a significant fraction of the pathogenic *E. coli*, what are the conserved regions in the proteins that are so conserved, or which proteins among the thousands of potential proteins can be used in a vaccine to produce a sufficient immune response to protect against pathogenic *E. coli* which requires screening large numbers of proteins to identify the best candidates.

It is an object of the invention to provide further and better antigens for use in immunisation against pathogenic *E. coli* strains, and more particularly against intestinal pathotypes (e.g. EAEC, EIEC, EPEC and ETEC strains) as well as ExPEC pathotypes.

DISCLOSURE OF THE INVENTION

One of the many antigens disclosed in reference 5 is annotated as 'orf353' (SEQ IDs 705 & 706 therein), which is also known as: 'orf236' from *E. coli* NMEC strain IHE3034, 'c0368' from *E. coli* strain CFT073 and ecp_0248 from *E. coli* strain 536. Another such antigen disclosed in reference 5 is annotated as Bacterial Ig-like domain (group 1) protein (also as 'orf405', SEQ IDs 809 & 810), which is also known as: 'orf284' from *E. coli* NMEC strain IHE3034, 'c0415' from *E. coli* strain CFT073 and ecp_0367 from *E. coli* strain 536. Yet another such antigen disclosed in reference 5 is annotated as Flu antigen 43 protein (also as 'orf1364', SEQ IDs 2727 & 2728), which is also known as: 'orf1109' from *E. coli* NMEC strain IHE3034, 'c1273' from *E. coli* strain CFT073 and ecp_3009 from *E. coli* strain 536. Yet another such antigen disclosed in reference 5 is annotated as NodT-family outer-membrane-factor-lipoprotein efflux transporter protein (also as 'orf1767', SEQ IDs 3533 & 3534), which is also known as: 'orf1488' from *E. coli* NMEC strain IHE3034, 'c1765' from *E. coli* strain CFT073 and ecp_1346 from *E. coli* strain 536. Yet another such antigen disclosed in reference 5 is annotated as gspK general secretion pathway protein (also as 'orf3515', SEQ IDs 7029 & 7030), which is also known as: 'orf3332' from *E. coli* NMEC strain IHE3034, 'c3702' from *E. coli* strain CFT073 and ecp_3039 from *E. coli* strain 536. Yet another such antigen disclosed in reference 5 is annotated as gspJ general secretion pathway protein (also as 'orf3516', SEQ IDs 7029 & 7030), which is also known as: 'orf3333' from *E. coli* NMEC strain IHE3034 and ecp_3040 from *E. coli* strain 536. Yet another such antigen disclosed in reference 5 is annotated as tonB-dependent siderophore receptor (also as 'orf3597', SEQ IDs 7193 & 7194), which is also known as: 'orf3415' from *E. coli* NMEC strain IHE3034, 'c3775' from *E. coli* strain CFT073 and ecp_3121 from *E. coli* strain 536. Yet another such antigen disclosed in reference 5 is annotated as Fimbrial protein (also as 'orf3613', SEQ IDs 7225 & 7226), which is also known as: 'orf3431' from *E. coli* NMEC strain IHE3034 and 'c3791' from *E. coli* strain CFT073. Yet another such antigen disclosed in WO2008/

020330 is annotated as Hemolysin A protein (also as 'recp3768', SEQ IDs 3), which is also known as: 'c3570' from *E. coli* strain CFT073 and ecp_3827 from *E. coli* strain 536. 'upec948' protein from *E. coli* UPEC is also known as: 'c0975 from *E. coli* strain CFT073. 'upec1232' protein from *E. coli* UPEC is disclosed in reference 6 (SEQ ID 138) is also known as: 'c1275 from *E. coli* strain CFT073. Yet another such antigen disclosed in reference 6 is annotated as Type-1 fimbrial protein, A chain precursor (also as 'upec1875', SEQ ID 221), which is also known as: 'orf1642' from *E. coli* NMEC strain IHE3034 and 'c1936' from *E. coli* strain CFT073. Yet another such antigen disclosed in reference 6 is annotated as YapH homolog protein (also as 'upec2820', SEQ ID 307), which is also known as: 'c2895' from *E. coli* strain CFT073. Reference 5, reference 6, WO2008/020330, and other references discloses the sequences from NMEC strain IHE3034 or UPEC strains, and certain aspects of the present invention are based on variants of the ExPEC 'orf353', the Bacterial Ig-like domain (group 1) protein, Flu antigen 43 protein, NodT-family outer-membrane-factor-lipoprotein efflux transporter protein, gspK general secretion pathway protein, gspJ general secretion pathway protein, tonB-dependent siderophore receptor, Fimbrial protein, 'upec948' protein, 'upec1232', Type-1 fimbrial protein, A chain precursor, and YapH homolog protein that have been identified in further pathotypes, including APEC, UPEC, EAEC, EIEC, EPEC and ETEC strains. Unlike the disclosure of reference 5, these variants can be particularly useful for treating intestinal pathotypes. Thus the invention provides such variants, together with their use in immunising patients against *E. coli* infections. In addition, this disclosure includes fragments of the each of the proteins—bacterial Ig-like domain (group 1) protein (orf405), flu antigen 43 (orf1364), NodT-family outer-membrane-factor-lipoprotein efflux transporter (orf1767), gspK (orf3515), gspJ (orf3516), tonB-dependent siderophore receptor (orf3597), fibrial protein (orf3613), upec-948, upec-1232, A chain precursor of the type-1 fimbrial protein (upec-1875), yapH homolog (upec-2820), hemolysin A (recp-3768), and Sel1 repeat-containing protein (upec-5211)—of all *E. coli* pathotypes where the fragments are conserved across multiple strains and therefore can provide an immune response in a subject that provides protection across several strains.

Polypeptides Used with the Invention

The invention provides a polypeptide comprising an amino acid sequence that is derived from orf353, bacterial Ig-like domain (group 1) protein (orf405), flu antigen 43 (orf1364), NodT-family outer-membrane-factor-lipoprotein efflux transporter (orf1767), gspK (orf3515), gspJ (orf3516), tonB-dependent siderophore receptor (orf3597), fibrial protein (orf3613), upec-948, upec-1232, A chain precursor of the type-1 fimbrial protein (upec-1875), yapH homolog (upec-2820), hemolysin A (recp-3768), and Sel1 repeat-containing protein (upec-5211), each as more fully described herein.

Orf353 Protein 'orf353' protein from *E. coli* NMEC is disclosed in reference 5 (SEQ IDs 705 & 706) is also known as: 'orf236' from *E. coli* NMEC strain IHE3034, 'c0368' from CFT073 and ecp_0248 from 536.

When used according to the present invention, orf353 protein may take various forms. Preferred orf353 sequences have 50% or more identity (e.g. 60%, 70%, 80%, 90%, 95%, 96%, 97%, 98%, 99% or more) to SEQ ID NOs 1-2. This includes variants (e.g. allelic variants, homologs, orthologs, paralogs, mutants etc).

Other preferred orf353 sequences comprise at least n consecutive amino acids from SEQ ID SEQ ID NOs 1-2, wherein n is 7 or more (eg. 8, 10, 12, 14, 16, 18, 20, 25, 30, 35, 40, 50, 60, 70, 80, 90, 100, 150, 200, 250 or more). Preferred fragments comprise an epitope or immunogenic fragment from orf353. Other preferred fragments lack one or more amino acids (e.g. 1, 2, 3, 4, 5, 6, 7, 8, 9, 10, 15, 20, 25 or more) from the C-terminus and/or the N-terminus of SEQ ID SEQ ID NOs 1-2. Exemplary fragments are the conserved fragments SEQ ID NOs identified in the sequence alignment below.

```
Group A: strain   IHE3034, RS218, APEC01, 536, UTI89 and F11 (SEQ ID NO: 1)
Strain            042 (SEQ ID NO: 2)
                  1                                                      50
Group A           MLKMSLYVII LLFSLQFSAA ITGKESEVVS PLLMDVNPSL TMENISELST
strain 042        MLKISLYVII LLFSFQISAA ITSKESEVVS PLLMDVNSSL TMENISELST
Consensus         MLK-SLYVII LLFS-Q-SAA IT-KESEVVS PLLMDVN-SL TMENISELST
                        SEQ ID NO: 211       SEQ ID NOs: 212-214     SEQ ID NO: 215
B-Cell Ep.                                   ********                ****

51                                                    100
Group A           SSEPSQQGVF PVICTRLHPG SVMKRQLLTG WGPVFIIGDD PFSLRWMSEH
strain 042        SSEPSQQGVF PVICTRLHPG SVMKRQLLTG WGPVFIIGDD PFSLRWMSEH
Consensus         SSEPSQQGVF PVICTRLHPG SVMKRQLLTG WGPVFIIGDD PFSLRWMSEH
B-Cell Ep.        ********

101                                                   150
Group A           LEILKSLNAL GLVVNVESVE RMEVLQQRAD GLLLLPVICD NFVQALQLNA
strain 042        LEILKSLNAL GLVVNVESVE RMEVLQQRAD GLLLLPVICD NFVQTLQLNA
Consensus         LEILKSLNAL GLVVNVESVE RMEVLQQRAD GLLLLPVICD NFVQ-LQLNA 151        162
Group A           YPVLITIMIE SQ
strain 042        YPVLITEMIE SQ
Consensus         YPVLITEMIE SQ
                  SEQ ID NO: 216

SEQ ID NO: 212    SAAIT(G/S)KESEVVSPLLMDVN
SEQ ID NO: 213    SAAITGKESEVVSPLLMDVN *
SEQ ID NO: 214    SAAITSKESEVVSPLLMDVN

B-Cell Epitopes

SEQ ID NO: 217    ITGKESEV
SEQ ID NO: 218    ELSTSSEPSQQG
```

Orf405 Protein

Bacterial Ig-like domain (group 1) protein is referred to herein as 'orf405.' 'orf405' protein from *E. coli* NMEC is disclosed in reference 5 (SEQ IDs 809 & 810) is also known as: 'orf284' from *E. coli* NMEC strain IHE3034, 'c0415' from CFT073 and ecp_0367 from 536.

When used according to the present invention, orf405 protein may take various forms. Preferred orf405 sequences have 50% or more identity (e.g. 60%, 70%, 80%, 90%, 95%, 96%, 97%, 98%, 99% or more) to SEQ ID NOs 3-18. This includes variants (e.g. allelic variants, homologs, orthologs, paralogs, mutants etc).

Other preferred orf405 sequences comprise at least n consecutive amino acids from SEQ ID NOs 3-18, wherein n is 7 or more (eg. 8, 10, 12, 14, 16, 18, 20, 25, 30, 35, 40, 50, 60, 70, 80, 90, 100, 150, 200, 250 or more). Preferred fragments comprise an epitope or immunogenic fragment from orf405. Other preferred fragments lack one or more amino acids (e.g. 1, 2, 3, 4, 5, 6, 7, 8, 9, 10, 15, 20, 25 or more) from the C-terminus and/or the N-terminus of SEQ ID NOs 3-18. Exemplary fragments are the conserved fragments SEQ ID NOs identified in the sequence alignment below. In addition, the three fragments tested for solubility and immunogenicity, 405A, 405B, and 405C, are underlined with 'A', 'B', and 'C', respectively.

```
strains B, C and 8739   (SEQ ID NO: 3)
strain H10407           (SEQ ID NO: 4)
strain 101-1            (SEQ ID NO: 5)
strain 536              (SEQ ID NO: 6)
strain F11              (SEQ ID NO: 7)
strain CFT073           (SEQ ID NO: 8)
Group A: strain         IHE3034, UTI89, RS218 and APECO1 (SEQ ID NO: 9)
strain E2348-69         (SEQ ID NO: 10)
strains B171 and E22    (SEQ ID NO: 11)
strain B7A              (SEQ ID NO: 12)
strain E110019          (SEQ ID NO: 13)
strain HS               (SEQ ID NO: 14)
strain E24377A          (SEQ ID NO: 15)
strain O42              (SEQ ID NO: 16)
Group B: strain         Sakai, EDL933, EC508, EC869, EC4024, EC4042, EC4045,
                        EC4076, EC4113, EC4115, EC4196, EC4206, EC4401, EC4486,
                        EC4501 and TW14588 (SEQ ID NO: 17)
strain SECEC            (SEQ ID NO: 18)

strains B, C and 8739   MSHYKTGHKQ PRFRYSVLAR CVAWANISVQ VLFPLAVTFT PVMAARAQHA
strain H10407           MSHYKTGHKQ PRFRYSVLAR CVAWANISVQ VLFPLAVTFT PVMAARAQHA
strain 101-1            MSHYKTGHKQ PRFRYSVLAR CVAWANISVQ VLFPLAVTFT PVMAARAQHA
strain 536              MSRYKTDNKQ PRFRYSVLAR CVAWANISVQ VLFPLAVTFT PVMAARAQHA
strain F11              MSRYKTDNKQ PRFRYSVLAR CVAWANISVQ VLFPLAVTFT PVMAARAQHA
strain CFT073           MSRYKTDNKQ PRFRYSVLAR CVAWANISVQ VLFPLAVTFT PVMAARAQHA
Group A                 MSRYKTDNKQ PRFRYSVLAR CVAWANISVQ VLFPLAVTFT PVMAARAQHA
strain E2348-69         MSRYKTGHKQ PRFRYSVLAR CVAWTNISVQ VLFPLAVTFT PVMAARAQHA
strains B171 and E22    MSRYKTGHKQ PLFRYSVLAR CVAWANISVQ VLFPLAVTFT PVMAAHAQHA
strain B7A              MSRYKTGHKQ PRFRYSVLAR CVAWANISVQ VLFPLAVTFT PVMAARAQHA
strain E110019          MSRYKTGHKQ PRFRYSVLAR CVAWANISVQ VLFPLAVTFT PVMAARAQHA
strain HS               MSRYKTDHKQ PRFRYSVLAR CVAWANISVQ VLFPLAVTFT PVMAARAQHA
strain E24377A          MSHYKTGHKQ PRFRYSVLAR CVAWANISVQ VLFPLAVTFT PVMAARAQHA
strain O42              MSRYKTGHKQ PRFRYSVLAR CVAWANISVQ VLFPLAVTFT PVMAARAQHA
Group B                 MSRYKTGHKQ PRFRYSVLAR CVAWANISVQ VLFPLAVTFT PVMAARAQHA
strain SECEC            MSRYKTGHKQ PQFRYSVLAR CVAWANISVQ VLFPLAVTFT PVMAARAQHA
Consensus               MS-YKT--KQ P-FRYSVLAR CVAW-NISVQ VLFPLAVTFT PVMAA-AQHA
                                    SEQ ID NO: 219   SEQ ID NO: 220
Frag                               AAAAAAAAAA AAAAAAAAAA AAAAAAAAAA 51                                                100
strains B, C and 8739   VQPRLSMGNT TVTADNNVEK NVASFAANAG TFLSSQPDSD ATRNFITGMA
strain H10407           VQPRLSMGNT TVTADNNVEK NVASFAANAG TFLSSQPDSD ATRNFITGMA
strain 101-1            VQPRLSMGNT TVTADNNVEK NVASFAANAG TFLSSQPDSD ATRNFITGMA
strain 536              VQPRLSMENT TVTADNNVEK NVASLAANAG TFLSSQPDSD ATRNFITGMA
strain F11              VQPRLSMENT TVTADNNVEK NVASLAANAG TFLSSQPDSD ATRNFITGMA
strain CFT073           VQPRLSMENT TVTADNNVEK NVASFAANAG TFLSSQPDSD ATRNFITGMA
Group A                 VQPRLSMENT TVTADNNVEK NVASFAANAG TFLSSQPDSD ATRNFITGMA
strain E2348-69         VQPRLSMGNT TVTADNNVEK NVASFAANAG TFLSSQPDSD ATRNFITGMA
strains B171 and E22    VQPRLSMENT TVTADNNVEK NVASFAANAG TFLSSQPDSD ATRNFITGMA
strain B7A              VQPRLSMGNT TVTADNNVEK NVASFAANAG TFLSSQPDSD ATRNFITGMA
strain E110019          VQPRLSMGNT TVTADNNVEK NVASFAANAG TFLSSQPDSD ATRNFITGMA
strain HS               VQPRLSMGNT TVTADNNVEK NVASFAANAG TFLSSQPDSD ATRNFITGMA
strain E24377A          VQPRLSMENT TVTADNNVEK NVASFAANAG TFLSSQPDSD ATRNFITGMA
strain O42              VQPRLSMENT TVAADNNVEK NVASFAANAG TFLSSQPDSD ATRNFITGMA
Group B                 VQPRLSMGNT TVTADNNVEK NVASFAANAG TFLSSQPDSD ATRNFITGMA
strain SECEC            VQPRLSMGNT TVTADSNVEK NVASFAANAG TFLSSQPDSD ATRNFITGMA
Consensus               VQPRLSM-NT TVtADnNVEK NVAS-AANAG TFLSSQPDSD ATRNFITGMA
                  SEQ ID NO: 221    SEQ ID NOs 222-5           SEQ ID NO: 683
B-Cell Ep.                     *   **********               ********* ***
Frag                    AAAAAAAAAA AAAAAAAAAA AAAAAAAAAA AAAAAAAAAA AAAAAAAAAA 101                                               150
strains B, C and 8739   TAKANQEIQE WLGKYGTARV KLNVDKDFSL KDSSLEMLYP IYDTPTNMLF
strain H10407           TAKANQEIQE WLGKYGTARV KLNVDKDFSL KDSSLEMLYP IYDTPTNMLF
```

```
                         -continued
strain 101-1           TAKANQEIQE WLGKYGTARV KLNVDKDFSL KDSSLEMLYP IYDTPTNMLF
strain 536             TAKANQEIQE WLGKYGTARV KLNVDKNFSL KDSSLEMLYP IYDTPTNMLF
strain F11             TAKANQEIQE WLGKYGTARV KLNVDKNFSL KDSSLEMLYP IYDTPTNMLF
strain CFT073          TAKANQEIQE WLGKYGTARV KLNVDKRFSL KDSSLEMLYP IYDTPTNMLF
Group A                TAKANQEIQE WLGKYGTARV KLNVDKNFSL KDSSLEMLYP IYDTPTNMLF
strain E2348-69        TAKANQEIQE WLGKYGTARV KLNVDKDFSL KDSSLEMLYP IYDTPTNMLF
strains B171 and E22   TAKANQEIQE WLGKYGTARV KLNVDKDFSL KDSSLEMLYP IYDTPTNMLF
strain B7A             TAKANQEIQE WLGKYGTARV KLNVDKDFSL KDSSLEMLYP IYDTPTNMLF
strain E110019         TAKANQEIQE WLGKYGTARV KLNVDKDFSL KDSSLEMLYP IYDTPTNMLF
strain HS              TAKANQEIQE WLGKYGTARV KLNVDKDFSL KDSSLEMLYP IYDTPTNMLF
strain E24377A         TAKANQEIQE WLGKYGTARV KLNVDKDFSL KDSSLEMLYP IYDTPTNMLF
strain O42             TAKANQEIQE WLGKYGTARV KLNVDKEFSL KDSSLEMLYP IYDTPTNMLF
Group B                TAKANQEIQE WLGKYGTARV KLNVDKDFSL KDSSLEMLYP IYDTPTNMLF
strain SECEC           TAKANQEIQE WLGKYGTARV KLNVDKDFSL KDSSLEMLYP IYDTPTNMLF
Consensus              TAKANQEIQE WLGKYGTARV KLNVDK-FSL KDSSLEMLYP IYDTPTNMLF
                                                          SEQ ID NO: 226
B-Cell Ep.             *******
Frag                   AAAAAAAAAA AAAAAAAAAA AAAAAAAAAA AAAAAAAAAA AAAAAAAAAA 151                                                200
strains B, C and 8739  TQGAIHRTDD RTQSNIGFGW RHFSGNDWMA GVNTFIDHDL SRSHTRIGVG
strain H10407          TQGAIHRTDD RTQSNIGFGW RHFSGNDWMA GVNTFIDHDL SRSHTRIGVG
strain 101-1           TQGAIHRTDD RTQSNIGFGW RHFSGNDWMA GVNTFIDHDL SRSHTRIGVG
strain 536             TQGAIHRTDD RTQSNIGFGW RHFSENDWMA GVNTFIDHDL SRSHTRIGVG
strain F11             TQGAIHRTDD RTQSNIGFGW RHFSENDWMA GVNTFIDHDL SRSHTRIGVG
strain CFT073          TQGAIHRTDD RTQSNIGFGW RHFSENDWMA GVNTFIDHDL SRSHTRIGVG
Group A                TQGAIHRTDD RTQSNIGFGW RHFSENDWMA GVNTFIDHDL SRSHTRIGVG
strain E2348-69        TQGAIHRTDD RTQSNIGFGW RHFSENDWMA GVNTFIDHDL SRSHTRIGVG
strains B171 and E22   TQGAIHRTDD RTQSNIGFGW RHFSGNDWMA GVNTFIDHDL SRSHTRIGVG
strain B7A             TQGAIHRTDD RTQSNIGFGW RHFSGNDWMA GVNTFIDHDL SRSHTRIGVG
strain E110019         TQGAIHRTDD RTQSNIGFGW RHFSGNDWMA GVNTFIDHDL SRSHTRIGVG
strain HS              TQGAIHRTDD RTQSNIGFGW RHFSGNDWMA GVNTFIDHDL SRSHTRIGVG
strain E24377A         TQGAIHRTDD RTQSNIGFGW RHFSGNDWMA GVNTFIDHDL SRSHTRIGVG
strain O42             TQGAIHRTDD RTQSNIGFGW RHFSGNDWMA GVNTFIDHDL SRSHTRIGVG
Group B                TQGAIHRTDD RTQSNIGFGW RHFSGNDWMA GVNTFIDHDL SRSHTRIGVG
strain SECEC           TQGAIHRTDD RTQSNIGFGW RHFSGNDWMA GVNTFIDHDL SRSHTRIGVG
Consensus              TQGAIHRTDD RTQSNIGFGW RHFS-NDWMA GVNTFIDHDL SRSHTRIGVG
                                                          SEQ ID NO: 227
B-Cell Ep.                        ****** *****
Frag                   AAAAAAAAAA AAAAAAAAAA AAAAAAAAAA AAAAAAAAAA AAAAAAAAAA 201                                                250
strains B, C and 8739  AEYWRDYLKL SANGYIRASG WKKSPDVEDY QERPANGWDI RAEGYLPAWP
strain H10407          AEYWRDYLKL SANGYIRASG WKKSPDVEDY QERPANGWDI RAEGYLPAWP
strain 101-1           AEYWRDYLKL SANGYIRASG WKKSPDVEDY QERPANGWDI RAEGYLPAWP
strain 536             AEYWRDYLKL SANGYIRASG WKTSPDVEDY QERPANGWDI RAEGYLPAWP
strain F11             AEYWRDYLKL SANGYIRASG WKTSPDVEDY QERPANGWDI RAEGYLPAWP
strain CFT073          AEYWRDYLKL SANGYIRASG WKKSPDVEDY QERPANGWDI RAEGYLPAWP
Group A                AEYWRDYLKL SANGYIRASG WKKSPDVEDY QERPANGWDI RAEGYLPAWP
strain E2348-69        AEYWRDYLKL SANGYIRASG WKKSPDVEDY QERPANGWDI RAEGYLPAWP
strains B171 and E22   AEYWRDYLKL SANGYIRASG WKKSPDIEDY QERPANGWDI RAEGYLPAWP
strain B7A             AEYWRDYLKL SANGYIRASG WKKSPDIEDY QERPANGWDI RAEGYLPAWP
strain E110019         AEYWRDYLKL SANGYIRASG WKKSPDIEDY QERPANGWDI RAEGYLPAWP
strain HS              AEYWRDYLKL SANGYIRASG WKKSPDIEDY QERPANGWDI RAEGYLPAWP
strain E24377A         AEYWRDYLKL SANGYIRASG WKKSPDVEDY QERPANGWDI RAEGYLPAWP
strain O42             AEYWRDYLKL SANGYIRASG WKKSPDVEDY QERPANGWDI RAEGYLPAWP
Group B                AEYWRDYLKL SANGYIRASG WKKSPDIEDY QERPANGWDI RAEGYLPAWP
strain SECEC           AEYWRDYLKL SANGYIRASG WKKSPDIEDY QERPANGWDI RAEGYLPAWP
Consensus              AEYWRDYLKL SANGYIRASG WK-SPD-EDY QERPANGWDI RAEGYLPAWP
                                                          SEQ ID NO: 228
B-Cell Ep.                        ** ********** **********  *   ******
Frag                   AAAAAAAAAA AAAAAAAAAA AAAAAAAAAA AAAAAAAAAA AAAAAAAAAA 251                                                300
strains B, C and 8739  QLGASLMYEQ YYGDEVGLFG KDKRQKDPHA ISAEVTYTPV PLLTLSAGHK
strain H10407          QLGASLMYEQ YYGDEVGLFG KDKRQKDPHA ISAEVTYTPV PLLTLSAGHK
strain 101-1           QLGASLMYEQ YYGDEVGLFG KDKRQKDPHA ISAEVTYTPV PLLTLSAGHK
strain 536             QLGASLMYEQ YYGDEVGLFG KDKRQKDPHA ITAEVNYTPV PLLTLSAGHK
strain F11             QLGASLMYEQ YYGDEVGLFG KDKRQKDPHA ITAEVNYTPV PLLTLSAGHK
strain CFT073          QLGASLMYEQ YYGDEVGLFG KDKRQKDPHA ITAEVNYTPV PLLTLSAGHK
Group A                QLGASLMYEQ YYGDEVGLFG KDKRQKDPHA ITAEVNYTPV PLLTLSAGHK
strain E2348-69        QLGASLMYEQ YYGDEVGLFG KDKRQKDPHA ITAEVNYTPV PLLTLSAGHK
strains B171 and E22   QLGASLMYEQ YYGDEVGLFG KDKRQKDPHA ISAEVTYTPV PLLTLSAGHK
strain B7A             QLGASLMYEQ YYGDEVGLFG KDKRQKDPHA ISAEVTYTPV PLLTLSAGHK
strain E110019         QLGASLMYEQ YYGDEVGLFG KDKRQKDPHA ISAEVTYTPV PLLTLSAGHK
strain HS              QLGASLMYEQ YYGDEVGLFG KDKRQKDPHA ISAEVTYTPV PLLTLSAGHK
strain E24377A         QLGASLMYEQ YYGDEVGLFG KDKRQKDPHA ISAEVTYTPV PLLTLSAGHK
strain O42             QLGASLMYEQ YYGDEVGLFG KDKRQKDPHA ITAEVNYTPV PLLTLSAGHK
```

-continued

```
Group B                  QLGASLMYEQ YYGDEVGLFG KDKRQKDPHA ISAEVTYTPV PLLTLSAGHK
strain SECEC             QLGASLMYEQ YYGDEVGLFG KDKRQKDPHA ISAEVTYTPV PLLTLSAGHK
Consensus                QLGASLMYEQ YYGDEVGLFG KDKRQKDPHA I-AEV-YTPV PLLTLSAGHK
                                                                     SEQ ID NO: 229
B-Cell Ep.               *          ********** *                     ***
Frag                     AAAAAAAAAA AAAAAAAAAA AAAAAAAAAA AAAAAAAAAA AAAAAAAAAA 301                                                   350
strains B, C and 8739    QGKSGENDTR FGLEVNYRIG EPLAKQLDTD SIRERRVLAG SRYDLVERNN
strain H10407            QGKSGENDTR FGLEVNYRIG EPLAKQLDTD SIRERRVLAG SRYDLVERNN
strain 101-1             QGKSGENDTR FGLEVNYRIG EPLAKQLDTD SIRERRVLAG SRYDLVERNN
strain 536               QGKSGENDTR FGLEVNYRIG EPLEKQLDTD SIRERRMLAG SRYDLVERNN
strain F11               QGKSGENDTR FGLEVNYRIG EPLEKQLDTD SIRERRMLAG SRYDLVERNN
strain CFT073            QGKSGENDTR FGLEVNYRIG EPLEKQLDTD SIRERRMLAG SRYDLVERNN
Group A                  QGKSGENDTR FGLEVNYRIG EPLEKQLDTD SIRERRMLAG SRYDLVERNN
strain E2348-69          QGKSGENDTR FGLEVNYRIG EPLEKQLDTD SIRERRMLAG SRYDLVERNN
strains B171 and E22     QGKSGENDTR FGLEVNYRIG EPLEKQLDTD SIRERRMLAG SRYDLVERNN
strain B7A               QGKSGENDTR FGLEVNYRIG EPLAKQLDTD SIRERRVLAG SRYDLVERNN
strain E110019           QGKSGENDTR FGLEVNYRIG EPLAKQLDTD SIRERRVLAG SRYDLVERNN
strain HS                QGKSGENDTR FGLEVNYRIG EPLEKQLDTD SIRERRMLAG SRYDLVERNN
strain E24377A           QGKSGENDTR FGLEVNYRIG EPLAKQLDTD SIRERRVLAG SRYDLVERNN
strain O42               QGKSGENDTR FGLEVNYRIG EPLEKQLDTD SIRERRMLAG SRYDLVERNN
Group B                  QGKSGENDTR FGLEVNYRIG EPLAKQLDTD SIRERRVLAG SRYDLVERNN
strain SECEC             QGKSGENDTR FGLEVNYRIG EPLAKQLDTD SIRERRVLAG SRYDLVERNN
Consensus                QGKSGENDTR FGLEVNYRIG EPL-KQLDTD SIRERR-LAG SRYDLVERNN
                                                   SEQ ID NO: 230 SEQ ID NO: 231
B-Cell Ep.               **********            ****** **
Frag                     AAAAAAAAAA AAAAAAAAAA AAAAAAAAAA AAAAAAAAAA AAAAAAAAAA 351                                                   400
strains B, C and 8739    NIVLEYRKSE VIRIALPERI EGKGGQTLSL GLVVSKATHG LKNVQWEAPS
strain H10407            NIVLEYRKSE VIRIALPERI EGKGGQTLSL GLVVSKATHG LKNVQWEAPS
strain 101-1             NIVLEYRKSE VIRIALPERI EGKGGQTLSL GLVVSKATHG LKNVQWEAPS
strain 536               NIVLEYRKSE VIRIALPERI EGKGGQTVSL GLVVSKATHG LKNVQWEAPS
strain F11               NIVLEYRKSE VIRIALPERI EGKGGQTVSL GLVVSKATHG LKNVQWEAPS
strain CFT073            NIVLEYRKSE VIRIALPERI EGKGGQTVSL GLVVSKATHG LKNVQWEAPS
Group A                  NIVLEYRKSE VIRIALPERI EGKGGQTVSL GLVVSKATHG LKNVQWEAPS
strain E2348-69          NIVLEYRKSE VIRIALPERI EGKGGQTVSL GLVVSKATHG LKNVQWEAPS
strains B171 and E22     NIVLEYRKSE VIRIALPERI EGKGGQTVSL GLVVSKATHG LKNVQWEAPS
strain B7A               NIVLEYRKSE VIRIALPERI EGKGGQTLSL GLVVSKATHG LKNVQWEAPS
strain E110019           NIVLEYRKSE VIRIALPERI EGKGGQTLSL GLVVSKATHG LKNVQWEAPS
strain HS                NIVLEYRKSE VIRIALPERI EGKGGQTLSL GLVVSKATHG LKNVQWEAPS
strain E24377A           NIVLEYRKSE VIRIALPERI EGKGGQTLSL GLVVSKATHG LKNVQWEAPS
strain O42               NIVLEYRKSE VIRIALPERI EGKGGQTLSL GLVVSKATHG LKNVQWEAPS
Group B                  NIVLEYRKSE VIRIALPERI EGKGGQTLSL GLVVSKATHG LKNVQWEAPS
strain SECEC             NIVLEYRKSE VIRIALPDRI AGRGGQTVSL GLVVSKATHG LKNVQWEAPS
Consensus                NIVLEYRKSE VIRIALP-RI eGKGGQT-SL GLVVSKATHG LKNVQWEAPS
                                            SEQ ID NO: 232-4    SEQ ID NO: 235
B-Cell Ep.                          * *******
Frag                     AAAAAAAAAA AAAAAAAAAA AAAAAAAAAA AAAAAAAAAA AAAAAAAAAA 401                                                   450
strains B, C and 8739    LLAEGGKITG QGSQWQVTLP AYRPGKDNYY AISAVAYDNK GNASKRVQTE
strain H10407            LLAEGGKITG QGSQWQVTLP AYRPGKDNYY AISAVAYDNK GNASKRVQTE
strain 101-1             LLAAGGKITG QGSQWQVTLP AYRPGKDNYY AISAVAYDNK GNASKRVQTE
strain 536               LLAAGGKITG QGNQWQVTLP AYQAGKDNYY AISAIAYDNK GNASKRVQTE
strain F11               LLAAGGKITG QGNQWQVTLP AYQAGKDNYY AISAIAYDNK GNASKRVQTE
strain CFT073            LLAAGGKITG QGNQWQVTLP AYQAGKDNYY AISAIAYDNK GNASKRVQTE
Group A                  LLAAGGKITG QGNQWQVTLP AYQAGKDNYY AISAIAYDNK GNASKRVQTE
strain E2348-69          LLAAGGKITG QGNQWQVTLP AYQAGKDNYY AISAIAYDNK GNASKRVQTE
strains B171 and E22     LLAEGGKITG QGSQWQVTLP AYRPGKDNYY AISAVAYDNK GNASKRVQTE
strain B7A               LLAEGGKITG QGSQWQVTLP AYRPGKDNYY AISAVAYDNK GNASKRVQTE
strain E110019           LLAEGGKITG QGSQWQVTLP AYRPGKDNYY AISAVANDNK GNASKRVQTE
strain HS                LLAEGGKITG QGSQWQVTLP AYRPGKDNYY AISAVAYDNK GNASKRVQTE
strain E24377A           LLAEGGKITG QGSQWQVTLP AYRPGKDNYY AISAVAYDNK GNASKRVQTE
strain O42               LLAEGGKITG QGSQWQVTLP AYRPGKDNYY AVSAIAYDNK GNASKRVQTE
Group B                  LLAEGGKITG QGSQWQVTLP AYRPGKDNYY AISAVAYDNK GNTSKRVQTE
strain SECEC             LLAAGGKITG QGSQWQVTLP AYQAGKDNYY AISAVAYDNK GNASKRVQTE
Consensus                LLA-GGKITG QG-QWQVTLP AY--GKDNYY A-SA-A--DNK GNASKRVQTE
                                                                     SEQ ID NO: 236
B-Cell Ep.                                                   *** *******
Frag                     AAAAAAAAAA AAAAAAAAAA AAAAAAAAAA AAAAAAAAAA AAAAAAAAAA 451                                                   500
strains B, C and 8739    VVITGAGMSA DRTALTLDGQ SRIQMLANGN EQRPLVLSLR DAEGQPVTGM
strain H10407            VVITGAGMSA DRTALTLDGQ SRIQMLANGN EQRPLVLSLR DAEGQPVTGM
strain 101-1             VVITGAGMSA DRTALTLDGQ SRIQMLANGN EQKPLVLSLR DAEGQPVTGM
strain 536               VVISGAGMSA DRTALTLDGQ SRIQMLANGN EQKPLVLSLR DAEGQPVTGM
strain F11               VVISGAGMSA DRTALTLDGQ SRIQMLANGN EQKPLVLSLR DAEGQPVTGM
strain CFT073            VVISGAGMSA DRTALTLDGQ SRIQMLANGN EQKPLVLSLR DAEGQPVTGM
Group A                  VVISGAGMSA DRTALTLDGQ SRIQMLANGN EQKPLVLSLR DAEGQPVTGM
```

```
                             -continued
strain E2348-69         VVISGAGMSA DRTALTLDGQ SRIQMLANGN EQKPLVLSLR DAEGQPVTGM
strains B171 and E22    VVITGAGMSA DRTALTLDGQ SRIQMLANGN EQRPLVLSLR DAEGQPVTGM
strain B7A              VVITGAGMSA DRTALTLDGQ SRIQMLANGN EQRPLVLSLR DAEGQPVTGM
strain E110019          VVITGAGMSA DRTALTLDGQ SRIQMLANGN EQRPLVLSLR DAEGQPVTGM
strain HS               VVITGAGMSA DRTALTLDGQ SRIQMLANGN EQRPLVLSLR DAEGQPVTGM
strain E24377A          VVITGAGMSA DRTALTLDGQ SRIQMLANGN EQRPLVLSLR DAEGQPVTGM
strain O42              VVISGAGMSA DRTALTLDGQ SRIQMLANGN EQKPLVLSLR DAEGQPVTGM
Group B                 VVITGAGMSA DRTALTLDGQ SRIQMLANGN EQKPLVLSLR DAEGQPVTGM
strain SECEC            VVITGAGMSA ERTALTLDGQ SRIQMLANGS EQKPLVLSLR DAEGQPVTGM
Consensus               VVI-GAGMSA -RTALTLDGQ SRIQMLANG- EQ-PLVLSLR DAEGQPVTGM
                                   SEQ ID NO: 237              SEQ ID NO: 238
B-Cell Ep.                                                  **********
Frag                    AAAAAAAAAA AAAAAAAAAA AAAAAAAAAA AAAAAAAAAA AAAAAAAAAA 501                                                  550
strains B, C and 8739   KDQIKTELAF KPAGNIVTRS LKATKSQAKP TLGEFTETEA GVYQSVFTTG
strain-H10407           KDQIKTELAF KPAGNIVTRS LKATKSQAKP TLGEFTETEA GVYQSVFTTG
strain 101-1            KDQIKTELTF KPAGNIVTRT LKATKSQAKP TLGEFTETEA GVYQSVFTTG
strain 536              KDQIKTELTF KPAGNIVTRS LKVTKSQAKP TLGEFTETEA GVYQSVFTTG
strain F11              KDQIKTELTF KPAGNIVTRS LKVTKSQAKP TLGEFTETEA GVYQSVFTTG
strain CFT073           KDQIKTELTF KPAGNIVTRT LKATKSQAKP TLGEFTETEA GVYQSVFTTG
Group A                 KDQIKTELTF KPAGNIVTRT LKATKSQAKP TLGEFTETEA GVYQSVFTTG
strain E2348-69         KDQIKTELTF KPAGNIVTRT LKATKSQAKP TLGEFTETEA GVYQSVFTTG
strains B171 and E22    KDQIKTELTF KPAGNIVTRT LKATKSQAKP TLGEFTETEA GVYQSVFTTG
strain B7A              KDQIKTELTF KPAGNIVTRT LKATKSQAKP TLGEFTETEA GVYQSVFTTG
strain E110019          KDQIKTELTF KPAGNIVTRT LKATKSQAKP TLGEFTETEA GVYQSVFTTG
strain HS               KDQIKTELTF KPAGNIVTRT LKATKSQAKP TLGEFTETEA GVYQSVFTTG
strain E24377A          KDQIKTELAF KPAGNIVTRS LKATKSQAKP TLGEFTETEA GVYQSVFTTG
strain O42              KDQIKTELTF KPAGNIVTRT LKATKSQAKP TLGEFTETEA GVYQSVFTTG
Group B                 KDQIKTELTF KPAGNIVTRS LKATKSQAKP TLGEFTETEA GVYQSVFTTG
strain SECEC            KDQIKTELTF KPAGNIVTRT LKATKSQAQP TLGEFTETEA GVYQSVFTTG
Consensus               KDQIKTEL-F KPAGNIVTR- LK-TKSQA-P TLGEFTETEA GVYQSVFTTG
                                   SEQ ID NO: 239              SEQ ID NO: 240
B-Cell Ep.              ***                *  ********** **        ***
Frag                    AAAAAAAAAA AAAAAAAAAA AAAAAAAAAA AAAAAAAAAA AAAAAAAAAA 551                                                  600
strains B, C and 8739   TQSGEATITV SVDGMSKTVT AELRATMMDV ANSTLSANEP SGDVVADGQQ
strain H10407           TQSGEATITV SVDGMSKTVT AELRATMMDV ANSTLSANEP SGDVVADGQQ
strain 101-1            TQSGEATITV SVDGMSKTVT AELRATMMDV ANSTLSANEP SGDVVADGQQ
strain 536              TQSGEATITV SVDGMSKTVT AELRATMMDV ANSTLSANEP SGDVVADGQQ
strain F11              TQSGEATITV SVDGMSKTVT AELRATMMDV ANSTLSANEP SGDVVADGQQ
strain CFT073           TQSGEATITV SVDDMSKTVT AELRATMMDV ANSTLSANEP SGDVVADGQQ
Group A                 TQSGEATITV SVDDMSKTVT AELRATMMDV SNSTLSANEP SGDVVADGQQ
strain E2348-69         TQSGEATITV SVDDMSKTVT AELRATMMNV ANSTLSANEP SGDVVADGRQ
strains B171 and E22    TQSGEATITV SVDGMSKTVT AELRATMMDV ANSTLSANEP SGDVVADGQQ
Strain B7A              TQSGEATITV SVDGMSKTVT AELRATMMDV ANSTLSANEP SGDVVADGQQ
strain E110019          TQSGEATITV SVDGMSKTVT AELRATMMDV ANSTLSANEP SGDVVADGQQ
strain HS               TQSGEATITV SVDGMSKTVT AELRATMMDV ANSTLSANEP SGDVVADGQQ
strain E24377A          TQSGEATITV SVDGMSKTVT AELRATMMDV ANSTLSANEP SGDVVADGQQ
strain O42              TQSGEATITV SVDGMSKTVT AELRATMMDV ANSTLSANEP SGDVVADGQQ
Group B                 TQSGEATITV SVDGMSKTVT AELRATMMDV ANSTLSANEP SGDVVADGQQ
strain SECEC            TQSGEATITV SVDDMSKTVT AELRATMMDV ANSTLSANEP SGDVVADGQQ
Consensus               TQSGEATITV SVD-MSKTVT AELRATMM-V -NSTLSANEP SGDVVADG-Q
                                   SEQ ID NO: 241              SEQ ID NO: 242
B-Cell Ep.              *******                           ******* ********
Frag                    AAAAAAAAAA AAAAAAAAAA AAAAAAAAAA AAAAAAAAAA AAABBBBBBB 601                                                  650
strains B, C and 8739   AYTLTLTAVD SEGNPVTGEA SRLRFVPQDT NGVTVGAISE IKPGVYSATV
strain H10407           AYTLTLTAVD SEGNPVTGEA SRLRFVPQDT NGVTVGAISE IKPGVYSATV
strain 101-1            AYTLTLTAVD SEGNPVTGEA SRLRFVPQDT NGVTVGAISE IKPGVYSATV
strain 536              AYTLTLTAVD SEGNPVTGEA SRLRLVPQDT NGVTVGAISE IKPGVYSATV
strain F11              AYTLTLTAVD SEGNPVTGEA SRLRLVPQDT NGVTVGAISE IKPGVYSATV
strain CFT073           AYTLTLTAVD SEGNPVTGEA SRLRLVPQDT NGVTVGAISE IKPGVYSATV
Group A                 AYTLTLTAVD SEGNPVTGEA SRLRLVPQDT NGVTVGAISE IKPGVYSATV
strain E2348-69         AYTLTLTAVD SEGNPVTGEA SRLRLVPQDT NGVTVGAISE IKPGGYSATV
strains B171 and E22    AYTLTLTAVD TDGNPVTGEA SRLRFVPQDT NGVTIGTISE IKPGVYSATV
strain B7A              AYTLTLTAVD TDGNPVTGEA SRLRFVPQDT NGVTIGTISE IKPGVYSATV
strain E110019          AYTLTLTAVD SEGNPVTGEA SRLRFVPQDT NGVTVGAISE IKPGVYSATV
strain HS               AYTLTLTAVD TDGNPVTGEA SRLRFVPQDT NGVTIGTISE IKPGVYSATV
strain E24377A          AYTLTLTAVD SEGNPVTGEA SRLRFVPQDT NGVTVGAISE IKPGVYSATV
strain O42              AYTLTLTAVD SEGNPVTGEA SRLRLVPQDT NGVTVGAISE IKPGVYSATV
Group B                 AYTLTLTAVD SEGNPVTGEA SRLRFVPQDT NGVTVGAISE IKPGVYSAAV
strain SECEC            SHTLTLTAVD TDGNPVTGEA SRLRLVPQDT NGVTVGAISE IKPGVYSATV
Consensus               --TLTLTAVD --GNPVTGEA SRLR-VPQDT NGVT-G-ISE IKPG-YSA-V
                                   SEQ ID NO: 243              SEQ ID NO: 244
B-Cell Ep.              ********            **** ****            **********
Frag                    BBBBBBBBBB BBBBBBBBBB BBBBBBBBBB BBBBBBBBBB BBBBBBBBBB 651                                                  700
```

```
                                                                                  -continued
strains B, C and 8739    SSTRAGNVVV RAFSEQYQLG TLQQTLKFVA GPLDAAHSSI TLNPDKPVVG
strain H10407            SSTRAGNVVV RAFSEQYQLG TLQQTLKFVA GPLDAAHSSI PLNPDKPVVG
strain 101-1             SSTRAGNVVV RAFSEQYQLG TLQQTLKFVA GPLDAAHSSI TLNPDKPVVG
strain 536               SSTRAGNVVV RAFSEQYQLG TLQQTLKFVA GPLDAAHSSI TLNPDKPVVG
strain F11               SSTRAGNVVV RAFSEQYQLG TLQQTLKFVA GPLDAAHSSI TLNPDKPVVG
strain CFT073            SSTRAGNVVV RAFSEQYQLG TLQQTLKFVA GPLDAAHSSI TLNPDKPVVG
Group A                  SSTRAGNVVV RAFSEQYQLG TLQQTLKFVA GPLDAAHSSI TLNPDKPVVG
strain E2348-69          SSTRAGNVVV RVFSEQYQLG TLQQTLKFVA GPLDAAHSSI TLNPDKPVVG
strains B171 and E22     SSTRAGNVVV RAFSEQYQLG TLQQTLKFVA GPLDAAHSSI TLNPDKPVVG
strain B7A               SSTRAGNVVV RAFSEQYQLG TLQQTLKFVA GPLDAAHSSI TLNPDKPVVG
strain E110019           SSTRAGNVVV RAFSEQYQLG TLQQTLKFVA GPLDAAHSSI TLNPDKPVVG
strain HS                SSTRAGNVVV RAFSEQYQLG TLQQTLKFVA GPLDAAHSSI TLNPDKPVVG
strain E24377A           SSTRAGNVVV RAFSEQYQLG TLQQTLKFVA GPLDAAHSSI TLNPDKPVVG
strain O42               SSTRAGNVVV RAFSEQYQLG TLQQTLKFVA GPLDAAHSSI TLNPDKPVVG
Group B                  SSTRAGNVVV RAFSEQYQLG TLQQTLKFVA GPLDAAHSSI TLNPDKPVVG
strain SECEC             SSTRAGNVVV RAFSEQYQLG TLQQTLKFVA GPLDAAHSSI TLNPDKPVVG
Consensus                SSTRAGNVVV R-FSEQYQLG TLQQTLKFVA GPLDAAHSSI -LNPDKPVVG
                         SEQ ID NO: 245     SEQ ID NO: 246     SEQ ID NO: 247
B-Cell Ep.               *****                                    *********
Frag                     BBBBBBBBBB BBBBBBBBBB BBBBBBBBBB BBBBBBBBBB BBBBBBBBBB 701                                                  750
strains B, C and 8739    GTVTAIWTAK DAYDNPVTSL TPEAPSLAGA AAVGSTASGW TNNGDGTWTA
strain H10407            GTVTAIWTAK DAYDNPVTSL TPEAPSLAGA AAVGSTASGW TNNGDGTWTA
strain 101-1             GTVTAIWTAK DANDNPVTGL NPDAPSLSGA AAVGSTASGW TDNGDGTWTA
strain 536               GTVTAIWTAK DANDNPVTGL NPDAPSLSGA AAAGSTASGW TDNGDGTWTA
strain F11               GTVTAIWTAK DANDNPVTGL NPDAPSLSGA AAAGSTASGW TDNGDGTWTA
strain CFT073            GTVTAIWTAK DANDNPVTGL NPDAPSLSGA AAAGSTASGW TDNGDGTWTA
Group A                  GTVTAIWTAK DANDNPVTGL NPDAPSLSGA AAAGSTASGW TDNGDGTWTA
strain E2348-69          GTVTAIWTAK DANDNPVTGL NPDAPSLSGA AAAGSTASGW TDNGDGTWTA
strains B171 and E22     GTVTAIWTVK DAYDNPVTSL TPEAPSLAGA AAVGSTASGW TNNGDGTWTA
strain B7A               GTVTAIWTVK DAYDNPVTSL TPEAPSLAGA AAVGSTASGW TNNGDGTWTA
strain E110019           GTVTAIWTAK DANDNPVTGL NPDAPSLSGA AAAGSTASGW TDNGDGTWTA
strain HS                GTVTAIWTAK DANDNPVTGL NPDAPSLSGA AAAGSTASGW TDNGDGTWTA
strain E24377A           GTVTAIWTVK DAYDNPVTSL TPEAPSLAGA AAVGSTASGW TNNGDGTWTA
strain O42               GTVTAIWTAK DANDNPVTGL NPDAPSLSGA AAAGSTASGW TDNGDGTWTA
Group B                  GTVTAIWTVK DAYDNPVTSL TPEAPSLAGA AAEGSTASGW TNNGDGTWTA
strain SECEC             GTVTAIWTAK DAYDNPVTSL TPEAPSLAGA AAVGSTASGW TNNGDGTWTA
Consensus                GTVTAIWT-K DA-DNPVT-L -P-APSL-GA AA-GSTASGW T-NGDGTWTA
                                                                SEQ ID NO: 248
B-Cell Ep.               *                              ******* **********
Frag                     BBBBBBBBBB BBBBBBBBBB BBBBBBBBBB BBBBBBBBBB BBBBBBBBBB 751                                                  800
strains B, C and 8739    QITLGSTAGE LEVMPKLNGQ DAAANAAKVT VVADALSSNQ SKVSVAEDHV
strain H10407            QITLGSTAGE LEVMPKLNGQ DAAANAAKVT VVADALSSNQ SKVSVAEDHV
strain 101-1             QISLGTTAGE LDVMPKLNGQ DAAANAAKVT VVADALSSNQ SKVSVAEDHV
strain 536               QISLGTTAGE LDVMPKLNGQ DAAANAAKVT VVADALSSNQ SKVSVAEDHV
strain F11               QISLGTTAGE LDVMPKLNGQ DAAANAAKVT VVADALSSNQ SKVSVAEDHV
strain CFT073            QISLGTTAGE LDVMPKLNGQ DAAANAAKVT VVADALSSNQ SKVSVAEDHV
Group A                  QISLGTTAGE LDVMPKLNGQ DAAANAAKVT VVADALSSNQ SKVSVAEDHV
strain E2348-69          QISLGTTAGE LDVMPKLNGQ DAAANAAKVT VVADALSSNQ SKVSVAEDHV
strains B171 and E22     QITLGSTAGE LEVMPKLNGQ DAAANAAKVT VVADALSSNQ SKVSVAEDHV
strain B7A               QITLGSTAGE LEVMPKLNGQ DAAANAAKVT VVADALSSNQ SKVSVAEDHV
strain E110019           QISLGTTAGE LEVIPKLNGQ DAAANAAKVT VVADALSSNQ SKVSVAEDHV
strain HS                QISLGTTAGE LEVIPKLNGQ DAAANAAKVT VVADALSSNQ SKVSVAEDHV
strain E24377A           QITLGSTAGE LEVMPKLNGQ DAAANAAKVT VVADALSSNQ SKVSVAEDHV
strain O42               QITLGSTAGE LEVMPKLNGQ DAAANAAKVT VVADALSSNQ SKVSVAEDHV
Group B                  QITLGSTAGE LEVMPKLNGQ NAAANAAKVT VVADALSSNQ SKVSVAEDHV
strain SECEC             QITLGSTAGE LDVMPKLNGQ DAAANAAKVT VVADALSSNQ SKVSVAEDHV
Consensus                QI-LG-TAGE L-V-PKLNGQ -AAANAAKVT VVADALSSNQ SKVSVAEDHV
                                                             SEQ ID NO: 249
B-Cell Ep.               ******     ***** ******              ***** ***** ***
Frag                     BBBBBBBBBB BBBBBBBBBB BBBBBBBBBB BBBBBBBBBB BBBBBBBBBB 801                                                  850
strains B, C and 8739    KAGESTTVTL IAKDAHGNTI SGLSLSASLT GTASEGATVS SWTEKGDGSY
strain H10407            KAGESTTVTL IAKDAHGNTI SGLSLSASLT GTASEGATVS SWTEKGDCSY
strain 101-1             KAGESTTVTL VAKDAHGNAI SGLSLSASLT GTASEGATVS SWTEKGDGSY
strain 536               KAGESTTVTL VAKDAHGNAI SGLSLSASLT GTASEGATVS SWTEKGDGSY
strain F11               KAGESTTVTL VAKDAHGNAI RGLSLSASLT GTASEGATVS SWTEKGDGSY
strain CFT073            KAGESTTVTL VAKDAHGNAI SGLSLSASLT GTASEGATVS SWTEKGDGSY
Group A                  KAGESTTVTL VAKDAHGNAI SGLSLSASLT GTASEGATVS SWTEKGDGSY
strain E2348-69          KAGESTTVTL VAKDAHGNAI SGLSLSASLT GTASEGATVS SWTEKGDGSY
strains B171 and E22     KAGESTTVTL IAKDAHGNAI SGLSLSASLT GTASEGATVS SWTEKGDGSY
strain B7A               KAGESTTVTL VAKDAHGNAI SGLSLSASLT GTASEGATVS SWTEKGDGSY
strain E110019           KAGESTTVTL VAKDAHGNAI SGLSLSASLT GTASEGATVS SWTEKGDGSY
strain HS                KAGESTTVTL IAKDAHGNAI SGLSLSASLT GAASEGATVS GWTEKGDGSY
strain E24377A           KAGESTTVTL VAKDAHGNAI SGLSLSASLT GTASEGATVS SWTEKGDGSY
strain O42               KAGESTTVTL IAKDAHGNAI SGLSLSASLT GTASEGATIS SWTEKGDGSY
Group B                  KAGESTTVTL VAKDAHGNAI SGLALSASLT GTASEGATVS SWTEKGNGSY
```

```
strain SECEC         KAGESTTVTL IAKDAHGNAI SGLSLSASLT GAASEGATVS SWTEKGDGSY
Consensus            KAGESTTVTL -AKDAHGN-I -GL-LSASLT G-ASEGATvS sWTEKG--SY
                                                               SEQ ID NO: 250-253
B-Cell Ep.           ******                                    ******** ******
Frag                 BBBBBBBBBB BBBBBBBBBB BBBBBBBBBB BBBBBBBBBB BBBBBBBBBB 851                                                     900
strains B, C and 8739 VATLTTGGKT GELRVMPLFN GQPAATEAAQ LTVIAGEMSS ANSTLVAANK
strain H10407        VATLTTGGKT GELRVMPLFN GQPAATEAAQ LTVIAGEMSS ANSTLVADNK
strain 101-1         VATLTTGGKT GELRVMPLFN GQPAATEAAQ LTVIAGEMSS ANSTLVADNK
strain 536           VATLTTGGKT GELRVMPLFN GQPAATEAAQ LTVIAGEMSS ANSTLVADNK
strain F11           VATLTTGGKT GELRVMPLFN GQPAATEAAQ LTVIAGEMSS ANSTLVADNK
strain CFT073        VATLTTGGKT GELRVMPLFN GQPAATEAAQ LTVIAGEMSS ANSTLVADNK
Group A              VATLTTGGKT GELRVMPLFN GQPAATEAAQ LTVIAGEMSS ANSTLVADNK
strain E2348-69      VATLTTGGKT GELRVMPLFN GQPAATEAAQ LTVIAGEMSS ANSTLVADNK
strains B171 and E22 VATLTTGGKT GELRVMPLFN GQPAATEAAQ LTVIAGEMSS ANSTLVADNK
strain B7A           VATLTTGGKT GELRVMPLFN GQPAATEAAQ LTVIAGEMSS ANSTLVADNK
strain E110019       VATLTTGGKT GELRVMPLFN GQPAATEAAQ LTVIAGEMSS ANSTLVADNE
strain HS            VATLTTGGKT GELLVMPLFN GQPAATEAAQ LTVIAGEMSS ANSTLVADNK
strain E24377A       VATLTTGGKT GELRVMPLFN GQPAATEAAQ LTVIAGEMSS ANSTLVADNK
strain O42           VATLTTGGKT GELRVMPLFN GQPAATEAAQ LTVIAGEMSS ANSTLVADNK
Group B              VATLTTGGKT GELRVMPLFN GQPAATEAAQ LTVIAGEMSS ANSTLVADNK
strain SECEC         VATLTTGGKT GELLVMPLFN GQPAATEAAQ LTVIAGEMSS ANSTLVADNK
Consensus            VATLTTGGKT GEL-VMPLFN GQPAATEAAQ LTVIAGEMSS ANSTLVA-N-
                     SEQ ID NO: 254      SEQ ID NO: 255
B-Cell Ep.             ***** *   ********
Frag                 BBBBBBBBBB BBBBBBBBBB BBBBBBBBBB BBBBBBBBBB BBBBBBBBBB 901                                                     950
strains B, C and 8739 APTVKMTTEL TFTVKDAYGN PVTGLKPDAP VFSGAASTGS ERPSAGNWTE
strain H10407        APTVKMTTEL TFTVKDAYGN PVTGLKPDAP VFSGAASTGS ERPSAGNWTE
strain 101-1         APTVKTTTEL TFTVKDAYGN PVTGMKPDAP VFSGAANTGS ERPSAGNWTE
strain 536           TPTVKTTTEL TFTVKDAYGN PVTGLKPDAP VFSGAASTGS ERPSAGNWTE
strain F11           TPTVKTTTEL TFTVKDAYGN PVTGLKPDAP VFSGAASTGS ERPSAGNWTE
strain CFT073        TPTVKTTTEL TFTVKDAYGN PVTGLKPDAP VFSGAASTGS ERPSAGNWTE
Group A              TPTVKTTTEL TFTMKDAYGN PVTGLKPDAP VFSGAASTGS ERPSAGNWTE
strain E2348-69      TPTVKTTTEL TFTVKDAYGN PVTGLKPDAP VFSGAASTGS ERPSAGNWTE
strains B171 and E22 APTVKTTTEL TFTVKDAYGN PVTGMKPDAP VFSGAASTGT ERPSTGDWTE
strain B7A           APTVKTTTEL TFTVKDAYGN PVTGMKPDAP VFSGAASTGT ERPSTGDWTE
strain E110019       APTVETTTKL TFTVKDAYGN LVTGLKPDAP QFSGAASTGT ERPSTGDWTE
strain HS            APTVKTTTKL TFTVKDAYGN LVTGLKPDAP QFSGAASTGT ERPSTGDWTE
strain E24377A       APTVKTTTEL TFTVKDAYGN PVTGMKPDAP VFSGAASTGT ERPSTGDWTE
strain O42           TPTVKTTTEL TFTVKDAYGN PVTGLKPDAP VFSGAASTGS ARPSAGSWTE
Group B              APTVKTTTEL TFTVKDAYGN PVTGLKPDAP VFSGAASTGS ERPSAGNWTE
strain SECEC         APTVKAITEL TFTAKDAYGN PVSGLKLDAP VFSGAASTGS ERPSAGNWTE
Consensus            -PTVK-TT-L TFT-KDAYGN -V-G-K-DAP -FSGAASTG- -RPS-G-WTE
Frag                 BBBBBBBBBB BBBBBBBBBB BBBBBBBBBB BBBBBBBBBB BBBBBBBBBB 951                                                    1000
strains B, C and 8739 KGNGVYVATL TLGSAAGQLS VMPRVNGQNA VAQPLVLNVA GDASKAEIRD
strain H10407        KGNGVYVATL TLGSAAGQLS VMPRVNGQNA VAQPLVLNVA GDASKAEIRD
strain 101-1         KGNGVYVATL TLGSAAGQLS VMPRVNGQNA VAQPLVLNVA GDASKAEIRD
strain 536           KGNGVYVSTL TLGSAAGQLS VMPRVNGQNA VAQPLVLNVA GDASKAEIRD
strain F11           KGNGVYVSTL TLGSAAGQLS VMPRVNGQNA VAQPLVLNVA GDASKAEIRD
strain CFT073        KGNGVYVSTL TLGSAAGQLS VMPRVNGQNA VAQPLVLNVA GDASKAEIRD
Group A              KGNGVYVSTL TLGSAAGQLS VMPRVNGQNA VAQPLVLNVA GDASKAEIRD
strain E2348-69      KGNGVYVSTL TLGSAAGQLS VMPRVNGQNA VAQPLVLNVA GDASKAEIRD
strains B171 and E22 TSNGVYVATL TLGSAAGQLS VMPRVNGQNA VAQPLVLNVA GDASKAEIRD
strain B7A           TSNGVYVATL TLGSAAGQLS VMPRVNGQNA VAQPLVLNVA GDASKAEIRD
strain E110019       TSNGVYVATL TLGSAAGQLS VMPRVNGQNA VAQPLVLNVA GDASKAEIRD
strain HS            TSNGVYVATL TLGSAAGQLS VMPRVNGQNA VAQPLVLNVA GDASKAEIRD
strain E24377A       TSNGVYVATL TLGSAAGQLS VMPRVNGQNA VAQPLVLNVA GDASKAEIRD
strain O42           QSNGVYVATL TLGSAAGQLS VMPRVNGQNA VAQPLVLNVA GDASRAVISD
Group B              KGNGVYVSTL TLGSAAGQLS VMPRVNGQNA VAQPLVLNVA GDASKAEIRD
strain SECEC         QSNGVYVATL TLGSAAGQLS VMPRVNGQNA VAQPLVLNVA GDASKAEIRD
Consensus            --NGVYV-TL TLGSAAGQLS VMPRVNGQNA VAQPLVLNVA GDAS-A-I-D
                                 SEQ ID NO: 256
B-Cell Ep.             ******* *
Frag                 BBBBBBBBBB BBBBBBBBBB BBBBBBBBBB BBBBBBBBBB BBBBBBBBBB 1001                                                   1050
strains B, C and 8739 MTVKVNNQLA NGQSANQITL TVVDSYGNPL QGQEVTLTLP QGVTSKTGNT
strain H10407        MTVKVNNQLA NGQSANQITL TVVDSYGNPL QGQEVTLTLP QGVTSKTGNT
strain 101-1         MTVKVNNQLA NGQSANQITL TVVDSYGNPL QGQEVTLTLP QGVTSKTGNT
strain 536           MTVKVNNQLA NGQSANQITL TVVDSYGNPL QGQEVTLTLP QGVTSKTGNT
strain F11           MTVKVNNQLA NGQSANQITL TVVDSYGNPL QGQEVTLTLP QGVTSKTGNT
strain CFT073        MTVKVNNQLA NGQSANQITL TVVDSYGNPL QGQEVTLTLP QGVTSKTGNT
Group A              MTVKVNNQLA NGQSANQITL TVVDSYGNPL QGQEVTLTLP QGVTSKTGNT
strain E2348-69      MTVKVNNQLA NGQSANQITL TVVDSYGNPL QGQEVTLTLP QGVTSKTGNT
strains B171 and E22 MTVKVDNQLA NGQSTNQVTL TVVDTYGNPL QGQNVTLTLP KGVTSKTGNT
strain B7A           MTVKVDNQLA NGQSTNQVTL TVVDTYGNPL QGQNVTLTLP KGVTSKTGNT
```

-continued

```
strain E110019       MTVKVDNQLA NGQSTNQVTL TVVDTYGNPL QGQNVTLTLP KGVTSKTGNT
strain HS            MTVKVDNQLA NGQSTNQVTL TVVDTYGNPL QGQNVTLTLP KGVTSKTGNT
strain E24377A       MTVKVDNQLA NGQSTNLVTL TVVDTYGNPL QGQEVTLNLP QGVTSKTGNT
strain O42           MAVKVNNQLA NGQSANQVTL TVVDSYGNPL QGQEVTLTLP QGVTSKTGNT
Group B              MTVKVNNQLA NGQSTNQITL TVVDTYGNPL QGQEVTLTLP QGVTSKTGNT
strain SECEC         MTVKVDNQLA NGQSTNQVTL TVVDTYGNPL QGQEVTLTLP QGVTSKTGNT
Consensus            M-VKV-NQLA NGQStN--TL TVVDSYGNPL QGQ-VTL-LP -GVTSKTGNT
                      SEQ ID NO: 257-9   SEQ ID NO: 260-62   SEQ ID NO: 263
B-Cell Ep.              ***  ******       ******  ***          *********
Frag                 BBBBBBBBCC CCCCCCCCCC CCCCCCCCCC CCCCCCCCCC CCCCCCCCCC 1051                                                1100
strains B, C and 8739 VTTNAAGKVD IELMSTVAGE HSITASVNNA QKTVTVKFKA DFSTGQATLE
strain H10407        VTTNAAGKVD IELMSTVAGE HSITASVNNA QKTVTVKFKA DFSTGQATLE
strain 101-1         VTTNAAGKVD IELMSTVAGE HSITASVNNA QKTVTVKFKA DFSTGQATLE
strain 536           VTTNAAGKVD IELMSTVAGE HNISASVNGA QKTVTVKFNA DASTGQANLQ
strain F11           VTTNAAGKVD IELMSTVAGE HNISASVNGA QKTVTVKFNA DASTGQANLQ
strain CFT073        VTTNAAGKVD IELMSTVAGE LEIEASVKNS QKTVKVKFKA DFSTGQASLE
Group A              VTTNAAGKVD IELMSTVAGE LEIEASVKNS QKTVKVKFKA DFSTGQASLE
strain E2348-69      VTTNAAGKVD IELMSTVAGE LEIEASVKNS QKTVKVKFKA DFSTGQASLE
strains B171 and E22 VTTDAAGKAD IELMSTVAGE HSITASVNNA QKTVTVKFKA DFSTGQASLE
strain B7A           VTTDAAGKAD IELMSTVAGE HSITASVNNA QKTVTVKFKA DFSTGQASLE
strain E110019       VTTDAAGKAD IELMSTVAGE HSITASVNNA QKTVTVKFKA DFSTGQASLE
strain HS            VTTDAAGKAD IELMSTVAGE HSITASVNNA QKTVTVKFKA DFSTGQASLE
strain E24377A       VTTNAAGKAD IELISTVAGE LEIAAAVKNS QKTVTVKFNA DASTGQANLQ
strain O42           VTTNAAGKAD IELISTVAGE LEIAAAVKNS QKTVTVKFNA DASTGQANLQ
Group B              VTTNAAGKAD IELMSTVAGE HNISASVNGA QKTVTVKFNA DASTGQANLQ
strain SECEC         VTTNAAGKAD IELISTVAGE LEIAAAVKNS QKTVTVKFNA DASTGQANLQ
Consensus            VTT-AAGK-D IEL-STVAGE --I-A-V--- QKTV-VKF-A D-STGQA-L-
B-Cell Ep.           ***        ********
Frag                 CCCCCCCCCC CCCCCCCCCC CCCCCCCCCC CCCCCCCCCC CCCCCCCCCC 1101                                                1150
strains B, C and 8739 VDGSTPKVAN DNDAFTLTAT VKDQYGNLLP GAVVVFNLPW GVKPLADGNI
strain H10407        VDGSTPKVAN DNDAFTLTAT VKDQYGNLLP GAVVVFNLPR GVKPLADGNI
strain 101-1         VDGSTPKVAN DNDAFTLTAT VKDQYGNLLP GAVVVFNLPR GVKPLADGNI
strain 536           VDTAVQKVAN GKDAFTLTAT VKDQYGNLLP GAVVVFNLPR GVKPLADGNI
strain F11           VDTAVQKVAN GKDAFTLTAT VKDQYGNLLP GAVVVFNLPR GVKPLADGNI
strain CFT073        VDAAAQKVAN GKDAFTLTAT VKDQYGNLLP GAVVVFNLPR GVKPLADGNI
Group A              VDAAAQKVAN GKDAFTLTAT VKDQYGNLLP GAVVVFNLPR GVKPLADGNI
strain E2348-69      VDAAAQKVAN GKDAFTLTAT VKDQYGNLLP GAVVVFNLPR GVKPLADGNI
strains B171 and E22 VDSAAPKVAN GKDAFTLTAT VEDKNGNPVP GSLVTFNLPR GVKPLTGDNV
strain B7A           VDSAAPKVAN GKDAFTLTAT VEDKNGNPVP GSLVTFNLPR GVKPLTGDNV
strain E110019       VDSAAPKVAN GKDAFTLTAT VEDKNGNPVP GSLVTFNLPR GVKPLTGDNV
strain HS            VDSAAPKVAN GKDAFTLTAT VEDKNGNPVP GSLVTFNLPR GVKPLTGDNV
strain E24377A       VDTAVQKVAN GKDAFTLTAT VEDKNGNPVP GSLVTFNLPR GVKPLTGDNV
strain O42           VDTAVQKVAN GKDAFTLTAT VEDKNGNPVP GTLVTFNLPR GVKPLTGDNV
Group B              VDAAAQKVAN GKDAFTLTAN VEDKNGNPVP GSLVTFNLPR GVKPLTGDNV
strain SECEC         VDAAAQKVAN GKDAFTLTAN VEDKNGNPVP GSLVTFNLPR GVKPLTGDNV
Consensus            VD----KVAN --DAFTLTA- V-D--GN--P G--V-FNLP- GVKPL---N-
Frag                 CCCCCCCCCC CCCCCCCCCC CCCCCCCCCC CCCCCCCCCC CCCCCCCCCC 1151                                                1200
strains B, C and 8739 MVNADKEGKA ELKVVSVTAG TYEITVSAGN DQPSNAQSVT FVADKTTATI
strain H10407        MVNADKEGKA ELKVVSVTAG TYEITASAGN DQPSNAQSVT FVADKTTATI
strain 101-1         MVNADKEGKA ELKVVSVTAG TYEITASAGN DQPSNAQSVT FVADKTTATI
strain 536           MVNADKEGKA ELKVVSVTAG TYEITASAGN DQPSNAQSVT FVADKTTATI
strain F11           MVNADKEGKA ELKVVSVTAG TYEITASAGN DQPSNAQSVT FVADKTTATI
strain CFT073        MVNADKEGKA ELKVVSVTAG TYEITASAGN DQPSNAQSVT FVADKTTATI
Group A              MVNADKEGKA ELKVVSVTAG TYEITASAGN DQPSNAQSVT FVADKTTATI
strain E2348-69      MVNADKEGKA ELKVGSVTAG TYEITASAGN DQPSNAQSVT FVADKTTATI
strains B171 and E22 WVKANGEGKA ELQVVSVTAG TYEITASAGN SQPSDTQTIT FVADKATATV
strain B7A           WVKANGEGKA ELQVVSVTAG TYEITASAGN SQPSDTQTIT FVADKATATV
strain E110019       WVKANGEGKA ELQVVSVTAG TYEITASAGN SQPSDTQTIT FVADKATATV
strain HS            WVKANDEGKA ELQVVSVTAG TYEITASAGN SQPSDTQTIT FVADKATATV
strain E24377A       WVKANDEGKA ELQVVSVTAG TYEITASAGN SQPSNTQTIT FVADKATATV
strain O42           WVKANDEGKA ELQVVSVTAG TYEITASAGN DQPSDAQTIT FVADKATATV
Group B              WVKANDEGKA ELQVVSVTAG TYEITASAGN SQPSNTQTIT FVADKATATV
strain SECEC         WVKANDEGKA ELQVVSVTAG TYEITASAGN DQPSDAQTIT FVADKTTATV
Consensus            -V-A--EGKA EL-V-SVTAG TYEITaSAGN -QPS--Q--T FVADK-TAT-
                                       SEQ ID NO: 264-6
B-Cell Ep.                             **********
Frag                 CCCCCCCCCC CCCCCCCCCC CCCCCCCCCC CCCCCCCCCC CCCCCCCCCC 1201                                                1250
strains B, C and 8739 SSIEVIGNRA VADGKTKQTY KVTVTDANNN LLKDSDVTLT ASSENLVLDP
strain H10407        SSIEVIGNRA VADGKTKQTY KVTVTDANNN LLKDSDVTLT ASSENLVLDP
strain 101-1         SSIEVIGNRA VADGKTKQTY KVTVTDANNN LLKDSDVTLT ASSENLVLDP
strain 536           SSIEVIGNRA VADGKTKQTY KVTVTDANNN LLKDSEVTLT ASPENLVLTP
strain F11           SSIEVIGNRA VADGKTKQTY KVTVTDANNN LLKDSEVTLT ASPENLVLTP
strain CFT073        SSIEVIGNRA VADGKTKQTY KVTVTDANNN LLKDSEVTLT ASPENLVLTP
```

-continued
```
Group A                SSIEVIGNRA VADGKTKQTY KVTVTDANNN LLKDSEVTLT ASPENLVLTP
strain 52348-69        SSIEVIGNRA VADGKTKQTY KVTVTDANNN LLKDSEVTLT ASPENLVLTP
strains B171 and E22   SGIEVMGNYA LADGKAKQTY KVTVTDANNN LVKDSEVTLT ASPASLNLEP
strain B7A             SGIEVMGNYA LADGKAKQTY KVTVTDANNN LVKDSEVTLT ASPASLNLEP
strain E110019         SGIEVIGNYA LADGKAKQTY KVTVTDANNN LVKDSEVTLT ASPASLNLEP
strain HS              SGIEVIGNYA LADGKAKQTY KVTVTDANNN LVKDSDVTLT ASPASLNLEP
strain E24377A         SGIEVMGNYA LADGKAKQTY KVTVTDANNN LVKDSEVTLT ASPASLNLEP
strain O42             SGIEVIGNYA LADGKAKQTY KVTVTDANNN LLKDSDVTLT ASPASLNLEP
Group B                SGIEVIGNYA LADGNAKQTY KVTVTDANNN LLKDSEVTLT ASPANLVLTP
strain SECEC           SGIEVIGNYA LADGKAKQTY KVTVTDANNN LLKDSEVTLT ASPANLALDP
Consensus              S-IEV-GN-A -ADG--KQTY KVTVTDANNN L-KDS-VTLT AS---L-L-P
                                      SEQ ID NO: 267
B-Cell Ep.                            ****  *******
Frag                   CCCCCCCCCC CCCCCCCCCC CCCCCCCCCC CCCCCCCCCC CCCCCCCCCC 1251                                              1300
strains B, C and 8739  KGTAKTNEQG QAVFTGSTTI AATYTLTAKV EQANGQVSTK TAESKFVADD
strain H10407          KGTAKTNEQG QAVFTGSTTI AATYTLTAKV EQANGQVSTK TAESKFVADD
strain 101-1           KGTAKTNEQG QAVFTGSTTI AATYTLTAKV EQANGQVSTK TAESKFVADD
strain 536             NGTATTNEQG QAIFTATTTV AATYTLTAKV EQADGQESTK TAESKFVADD
strain F11             NGTATTNEQG QAIFTATTTV AATYTLTAKV EQADGQESTK TAESKFVADD
strain CFT073          NGTATTNEQG QAIFTATTTV AATYTLTAKV EQADGQESTK TAESKFVADD
Group A                NGTATTNEQG QAIFTATTTV AATYTLTAKV EQADGQESTK TAESKFVADD
strain E2348-69        NGTATTNEQG QAIFTATTTV AATYTLTAKV EQADGQESTK TAESKFVADD
strains B171 and E22   NGTATTNEQG QAIFTATTTV AATYTLKAQV SQTNGQVSTK TAESKFVADD
strain B7A             NGTATTNEQG QAIFTATTTV AATYTLKAQV SQTNGQVSTK TAESKFVADD
strain E110019         NGTATTNEQG QAIFTATTTV AATYTLKAQV SQTNGQVSTK TAESKFVADD
strain HS              NGTATTNEQG QAIFTATTTV AATYTLKAQV SQTNGQVSTK TAESKFVADD
strain E24377A         NGTATTNEQG QAIFTATTTV AATYTLKAQV SQTNGQVSTK TAESKFVADD
strain O42             NGTATTNEQG QAIFTATTTV AATYTLKAQV SQTNGQVSTK TAESKFVADD
Group B                NGTAKTNEQG QAIFTATTTV AAKYTLTAKV SQADGQESTK TAESKFVADD
strain SECEC           DGTAKTNEQG QAIFTATTTV AAKYTLTAKV EQANGQESTK TAESKFVADD
Consensus              -GTA-TNEQG QA-FT--TT- AA-YTL-A-V -Q--GQ-STK TAESKFVADD
                                                                 SEQ ID NO: 268
B-Cell Ep.                                            ***  *********
Frag                   CCCCCCCCCC CCCCCCCCCC CCCCCCCCCC CCCCCCCCCC CCCCCCCCCC 1301                                              1350
strains B, C and 8739  KNAVLAASPE RVDSLVADGK TTATMTVTLM AGVNPVGGSM WVDIEAPEGV
strain H10407          KNAVLAASPE RVDSLVADGK TTATMTVTLM AGVNPVGGSM WVDIEAPEGV
strain 101-1           KNAVLAASPE RVDSLVADGK TTATMTVTLM AGVNPVGGSM WVDIEAPEGV
strain 536             KNAELAATSD .VHSLVADGV TTATLTVTLF SANNPVGGTM WVDIEAPEGV
strain F11             KNAELAATSD .VHSLVADGV TTATLTVTLF SANNPVGGTM WVDIEAPEGV
strain CFT073          KNAVLAASPE RVDSLVADGK TTATLTVTLM SGVNPVGGTM WVDIEAPEGV
Group A                KNAVLAASPE RVDSLVADGK TTATLTVTLM SGVNPVGGTM WVDIEAPEGV
strain E2348-69        KNAVLAASPE RVDSLVADGK TTATLTVTLM SGVNPVGGTM WVDIEAPEGV
strains B171 and E22   KNAVLTASSD .MQSLVADGK STAKLEVTLM SANNPVGGNM WVDIQTPEGV
strain B7A             KNAVLTASSD .MQSLVADGK STAKLEVTLM SANNPVGGNM WVDIQTPEGV
strain E110019         KNAVLTASSD .MQSLVADGK STAKLEVTLM SANNPVGGNM WVDIQTPEGV
strain HS              KNAVLTASSD .MQSLVADGK STAKLEVTLM SANNPVGGNM WVDIQTPEGV
strain E24377A         KNAVLTASSD .MQSLVADGK STAKLEVTLM SANNPVGGNM WVDIQTPEGV
strain O42             KNAELTASSD .VQSLVADGK STAKLEVTLF SANNPVGGNV WVDIEAPEGV
Group B                TNAVLTASSD .VTSLVADGI STAKLEVTLM SANNPVGGNM WVDIKTPEGV
strain SECEC           KNAVLAASSD .VTSLVADGV QTATMTVTLF SANNPVGGNV WVDIEAPEGV
Consensus              -NA-L-A--- ---SLVADG- -TA---VTL- ---NPVGG-- WVDI--PEGV
B-Cell Ep.                                                               ****
Frag                   CCCCCCCCCC CCCCCCCCCC CCCCCCCCCC CCCCCCCCCC CCCCCCCCCC 1351                                              1400
strains B, C and 8739  TEKDYQFLPS KADHFSGGKI TRTFSTSKPG VYTFTFNALT YGGYEMTPVK
strain H10407          TEKDYQFLPS KADHFSGGKI TRTFSTSKPG VYTFTFNALT YGGYEMTPVK
strain 101-1           TEKDYQFLPS KADHFSGGKI TRTFSTSKPG VYTFTFNALT YGGYEMTPVK
strain 536             TEADYQFLPS KNDHFASGKI TRTFSTNKPG TYTFTFNSLT YGGYEMKPVT
strain F11             TEADYQFLPS KNDHFASGKI TRTFSTNKPG TYTFTFNSLT YGGYEMKPVT
strain CFT073          TEADYQFLPS KNDHFASGKI TRTFSTNKPG TYTFTFNSLT YGGYEMKPVT
Group A                TEADYQFLPS KNDHFASGKI TRTFSTNKPG TYTFTFNSLT YGGYEMKPVT
strain E2348-69        TEADYQFLPS KNDHFASGKI TRTFSTNKPG TYTFTFNSLT YGGYEMKPVT
strains B171 and E22   TEKDYQFLPS KNDHFVSGKI TRKFSTSKPG VYTFTFNALT YGGYEMKPVT
strain B7A             TEKDYQFLSS KNDHFVSGKI TRKFSTSKPG VYTFTFNALT YGGYEMKPVT
strain E110019         TEKDYQFLPS KNDHFVSGKI TRKFSTSKPG VYTFTFNALT YGGYEMKPVT
strain HS              TEKDYQFLPS KNDHFVSGKI TRKFSTSKPG VYTFTFNALT YGGYEMKPVT
strain E24377A         TEKDYQFLPS KNDHFVSGKI TRKFSTSKPG VYTFTFNALT YGGYEMKPVT
strain O42             TEKDYQFLPS KNDHFVSGKI TRTFSTSKPG VYTFTFNALT YGGYEMKPVT
Group B                TEKDYQFLPS KNDHFVSGKI TRTFSTSKPG VYTFTFNALT YGGYEMKPVT
strain SECEC           TEKDYQFLPS KNDHFVSGKI TRTFSTNKPG TYTFTFNSLT YGGYEMKPVT
Consensus              TEkDYQFL-S K-DHF--GKI TR-FST-KPG -YTFTFN-LT YGGYEM-PV-
                                                                 SEQ ID NO: 269-71
B-Cell Ep.             **
Frag                   CCCCCCCCCC CCCCCCCCCC CCCCCCCCCC CCCCCCCCCC CCCCCCCCCC 1401       1418
```

-continued

```
strains B, C and 8739   VTINAVAAET ENGEEEMP
strain H10407           VTINAVAAET ENGEEEMP
strain 101-1            VTINAVAAET ENGEEEMP
strain 536              VTINAVPADT EGAEEK--
strain F11              VTINAVPADT EGAEEK--
strain CFT073           VTINAVPADT EGAEEK--
Group A                 VTINAVPADT EGAEEK--
strain E2348-69         VTINAVPADT EGAEEK--
strains B171 and E22    VTITAVDDT  AKDEEAMK
strain B7A              VTITAVDDT  AKDEEAMK
strain E110019          VTITAVDDT  AKDEEAMK
strain HS               VTITAVDDT  AKDEEAMK
strain E24377A          VTITAVDDT  AKDEEAMK
strain O42              VTITAVDDT  AKGEEAMK
Group B                 VTITAVDDT  AKGEEAMN
strain SECEC            VTITAVDANT ATGEEAMK
Consensus               VTI-AV-A-T ---EE---
Frag                    CCCCCCCCCC CCCCCCCC

SEQ ID NO: 222          NTTV(T/A)AD(N/S)NVEKNVAS

SEQ ID NO: 223          NTTVAADNNVEKNVAS

SEQ ID NO: 224          NTTVTADSNVEKNVAS

SEQ ID NO: 225          NTTVTADNNVEKNVAS

SEQ ID NO: 232          RI(E/A)GKGGQT

SEQ ID NO: 233          RIEGKGGQT

SEQ ID NO: 234          RIAGKGGQT

SEQ ID NO: 250          ASEGAT(V/I)S(S/G)WTEKG

SEQ ID NO: 251          ASEGATISSWTEKG

SEQ ID NO: 252          ASEGATVSSWTEKG

SEQ ID NO: 253          ASEGATVSSWTEKG

SEQ ID NO: 257          NQLA NGQS(T/A)N

SEQ ID NO: 258          NQLA NGQSTN

SEQ ID NO: 259          NQLA NGQSAN

SEQ ID NO: 260          TLTVVD(S/T)YGNPLQGQ

SEQ ID NO: 261          TLTVVDSYGNPLQGQ

SEQ ID NO: 262          TLTVVDTYGNPLQGQ

SEQ ID NO: 264          SVTAGTYEIT(A/V)SAGN

SEQ ID NO: 265          SVTAGTYEITASAGN

SEQ ID NO: 266          SVTAGTYEITVSAGN

SEQ ID NO: 269          PEGVTE(K/A)DYQFL

SEQ ID NO: 270          PEGVTEKDYQFL

SEQ ID NO: 271          PEGVTEADYQFL

B-Cell Epitopes

SEQ ID NO: 272          TTVTADNNVEK

SEQ ID NO: 273          FLSSQPDSDATR

SEQ ID NO: 274          TAKANQE

SEQ ID NO: 275          IHRTDDRTQSN

SEQ ID NO: 276          SGWKKSPDVEDYQERPANGWDIR

SEQ ID NO: 277          YLPAWPQ

SEQ ID NO: 278          KDKRQKDPHAI
```

| SEQ ID NO: 279 | GHKQGKSGENDTR |
| --- | --- |
| SEQ ID NO: 280 | KQLDTDSI |
| SEQ ID NO: 281 | IEGKGGQT |
| SEQ ID NO: 282 | DNKGNASKRV |
| SEQ ID NO: 283 | DAEGQPVTGMKDQ |
| SEQ ID NO: 284 | PTLGEFTETEAGV |
| SEQ ID NO: 285 | TTGTQSGEAT |
| SEQ ID NO: 286 | TLSANEPSGDVVADG |
| SEQ ID NO: 287 | GNPVTGEA |
| SEQ ID NO: 288 | PQDTNGVT |
| SEQ ID NO: 289 | IKPGVYSATVSSTRA |
| SEQ ID NO: 290 | LNPDKPVVGG |
| SEQ ID NO: 291 | GSTASGWTNNGDGTWTA |
| SEQ ID NO: 292 | GSTAGE |
| SEQ ID NO: 293 | KLNGQDAAANA |
| SEQ ID NO: 294 | LSSNQSKVSV |
| SEQ ID NO: 295 | DHVKAGEST |
| SEQ ID NO: 296 | ASEGATVSSWTEKG |
| SEQ ID NO: 297 | TGGKTG |
| SEQ ID NO: 298 | GQPAATEA |
| SEQ ID NO: 299 | RVNGQNAV |
| SEQ ID NO: 300 | QLANGQSTN |
| SEQ ID NO: 301 | SYGNPLQGQ |
| SEQ ID NO: 302 | GVTSKTGNTVTT |
| SEQ ID NO: 303 | LMSTVAGE |
| SEQ ID NO: 304 | TYEITASAGN |
| SEQ ID NO: 305 | KQTYKVTVTDA |
| SEQ ID NO: 306 | STKTAESKEVAD |
| SEQ ID NO: 307 | PEGVTE |

Orf1364 Protein

Flu antigen 43 protein is referred to herein as 'orf1364.' 'orf1364' protein from *E. coli* NMEC is disclosed in reference 5 (SEQ IDs 2727 & 2728) is also known as: 'orf1109' from *E. coli* NMEC strain IHE3034, 'c1273' from CFT073 and ecp_3009 from 536.

When used according to the present invention, orf1364 protein may take various forms. Preferred orf1364 sequences have 50% or more identity (e.g. 60%, 70%, 80%, 90%, 95%, 96%, 97%, 98%, 99% or more) to SEQ ID NOs 19-40. This includes variants (e.g. allelic variants, homologs, orthologs, paralogs, mutants etc).

Other preferred orf1364 sequences comprise at least n consecutive amino acids from SEQ ID NOs 19-40, wherein n is 7 or more (eg. 8, 10, 12, 14, 16, 18, 20, 25, 30, 35, 40, 50, 60, 70, 80, 90, 100, 150, 200, 250 or more). Preferred fragments comprise an epitope or immunogenic fragment from orf1364. Other preferred fragments lack one or more amino acids (e.g. 1, 2, 3, 4, 5, 6, 7, 8, 9, 10, 15, 20, 25 or more) from the C-terminus and/or the N-terminus of SEQ ID NOs 19-40. Exemplary fragments are the conserved fragments SEQ ID NOs identified in the sequence alignment below.

```
strain E110019        (SEQ ID NO: 19)
Group A: strain       Sakai, EDL933, EC508, EC869, EC4024, EC4042, EC4045,
                      EC4076, EC4113, EC4196, EC4206, EC4401, EC4486, EC4501
                      and TW14588 (SEQ ID NO: 20)
```

-continued

| | |
|---|---|
| strain B171 | (SEQ ID NO: 21) |
| strain E22 | (SEQ ID NO: 22) |
| strain B171 | (SEQ ID NO: 23) |
| strain B171 | (SEQ ID NO: 24) |
| strain E24377A and O42 | (SEQ ID NO: 26) |
| strain E24377A | (SEQ ID NO: 25) |
| Group B: strain | UTI89, RS218 and IHE3034 (SEQ ID NO: 27) |
| strain E110019 | (SEQ ID NO: 28) |
| strain E22 | (SEQ ID NO: 29) |
| strain H10407 | (SEQ ID NO: 30) |
| strain F11 and 536 | (SEQ ID NO: 31) |
| strain SECEC | (SEQ ID NO: 32) |
| strain H10407 | (SEQ ID NO: 33) |
| strain W3110 and DH10B | (SEQ ID NO: 34) |
| strain MG1655 | (SEQ ID NO: 35) |
| strain O42 | (SEQ ID NO: 36) |
| strain B7A | (SEQ ID NO: 37) |
| strain CFT073 | (SEQ ID NO: 38) |
| strain O42 | (SEQ ID NO: 39) |
| strain CFT073 | (SEQ ID NO: 40) |

```
                                1                                                 50
strain E110019          MKRHLNTSYR LVWNHITGTL VVASELARSR GKRAGVAVAL SLAAVTSVPA
Group A                 MKRHLNTSYR LVWNHITGTL VVASELARSR GKRAGVAVAL SLAAVTSVPA
strain B171             MKRHLNTSYR LVWNHITGTL VVASELARSR GKRAGVAVAL SLAAVTSVPA
strain E22              MKRHLNTSYR LVWNHITGTL VVASELARSR GKRAGVAVAL SLAAVTSVPA
strain B171             MKRHLNTSYR LVWNHITGTL VVASELARSR GKRTGVAVAL SLAAVTSVPV
strain B171             MKRHLNTSYR LVWNHITGTL VVASELARSR GKRTGVAVAL SLAAVTSVPV
strain E24377A and O42  MKRHLNTSYR LVWNHITGTL VVASELARSR GKRTGVAVAL SLAAVTSVPV
strain E24377A          MKRHLNTSYR LVWNHITGTL VVASELARSR GKRAGVAIAL SLAAVTSVPA
Group B                 MKRHLNTSYR LVWNHITGTL VVASELARSR GKGAGVAVAL SLAAVTSVPA
strain E110019          MKRHLNTSYR LVWNHITGTL VVASELARSR GKRTGVAVAL SLAAVTSVPV
strain E22              MKRHLNTSYR LVWNHITGTL VVASELARSR GKRAGVAVAL SLAAVTSVPA
strain H10407           MKRHLNTSYR LVWNHITGTL VVASELARSR GKRAGVAIAL SLAAVTSVPA
strain F11 and 536      MKRHLNTSYR LVWNHITGTL VVASELARSR GKRAGVAVAL SLAAVTSVPA
strain SECEC            MKRHLNTSYR LVWNHITGTL VVASELARSR GKRAGVAVAL SLAAVTPVPA
strain H10407           MKRHLNTSYR LVWNHITGTL VVASELARSR GKRTGVAVAL SLATATSVPA
strain W3110 and DH10B  MKRHLNTCYR LVWNHMTGAF VVASELARAR GKRGGVAVAL SLAAVTSLPV
strain MG1655           MKRHLNTCYR LVWNHMTGAF VVASELARAR GKRGGVAVAL SLAAVTSLPV
strain O42              MKRHLNTCYR LVWNHITGAF VVASELARAR GKRGGVAVAL SLAAVTSLPV
strain B7A              MKRHLNTSYR LVWNHITGTL VVASELARSR GKRAGVAVAL SLAAVTSVPA
strain CFT073           MKRHLNTSYR LVWNHITGAF VVASELARAR GKRAGVAVAL SLAAATSLPA
strain O42              MKRHLNTCYR LVWNHITGAF VVASELARAR GKRGGVAVAL SLAAVTSLPV
strain CFT073           MKRHLNTCYR LVWNHITGAF VVASELARAR GKRGGVAVAL SLAAVTPLPV
Consensus               MKRHLNT-YR LVWNH-TG-- VVASELAR-R GK--GVA-AL SLA--T--P-
B-Cell Ep.                                              ***  *****

51                                               100
strain E110019          LAADKVVQAG ETVNDGTLTN HDNQIVFGTA NGMTISTGLE LGPDSEENTG
Group A                 LAADKVVQAG ETVNDGTLTN HDNQIVFGTA NGMTISTGLE LGPDSEENTG
strain B171             LAADTVVQAG ETVNGGTLTN HDNQIVLGTA NGMTISTGLE LGPDSEENTG
strain E22              LAADTVVQAG ETVNGGTLTN HDNQIVLGTA NGMTISTGLE LGPDSEENTG
strain B171             LAADTVVQAG ETVSGGTLTN HDNQIVLGTA NGMTISTGLE YGPDNEANTG
strain B171             LAADTVVQAG ETVSGGTLTN HDNQIVLGTA NGMTISTGLE YGPDNEANTG
strain E24377A and O42  LAADTVVQAG ETVSGGTLTN HDNQIVFGTA NGMTISTGLE YGPDNEANTG
strain E24377A          LAADTVVQAG ETVNDGTLTN HDNQIVLGTA NGMTISTGLE YGPDNEANTG
Group B                 LAADTVVQAG ETVNGGTLTN HDNQIVLGTA NGMTISTGLE YGPDNEANTG
strain E110019          LAADTVVQAG ETVSGGTLTN HDNQIVFGTA NGMTISTGLE YGPDNEANTG
strain E22              LAADTVVQAG ETVNGGTLVN HDNQIVFGTA NGMTISTGLE YGPDNEANTG
strain H10407           LAADTVVQAG ETVSGGTLTN HDNQIVFGTA NGMTISSGLE YGPDNEANTG
strain F11 and 536      LAADTVVQAG ETVNDGTLTN HDNQIVLGTA NGMTISTGLE YGPDNEANTG
strain SECEC            LAADTVVEAG ETVNGGTLTN HDNQIVFGTT NGMTISTGLE YGTDNEANTG
strain H10407           LAADSVVQAG ETVSGGTLEN HDNQIVFGTT NGITISTGLE YGPDNEANTG
strain W3110 and DH10B  LAADIVVHPG ETVNGGTLAN HDNQIVFGTT NGMTISTGLE YGPDNEANTG
strain MG1655           LAADIVVHPG ETVNGGTLAN HDNQIVFGTT NGMTISTGLE YGPDNEANTG
strain O42              LAADIVVHPG ETVNGGTLAN HDNQIVFGTT NGMTISTGLE YGPDNEANTG
strain B7A              LAADKVVQAG ETVNDGTLTN HDNQIVLGTA NGMTISTGLE YGPDNEANTG
strain CFT073           LAADSVVPAG ETVNGGTLIN HDRQFVSGTA DGMTVSTGLE LGADSDNNTG
strain O42              LAADIVVHPG ETVNGGTLVN HDNQFVSGTA DGVTVSTGLE LGPDSDDNTG
strain CFT073           LSADIVVHPG ETVNGGTLVN HDNQFVSGTA NGVTVSTGLE LGPDSDENTG
Consensus               L-AD-VV--G ETV--GTL-N HD-Q-V-GT- -G-T-S-GLE -G-D---NTG
B-Cell Ep.                *  ********                     ***  **********

101                                              150
strain E110019          GQWIQNGGIA GNTTVTTNGR QVVLEGGTAS DTVIRDGGGQ SLNGLAVNTT
Group A                 GQWIQNGGIA GNTTVTTNGR QVVLEGGTAS DTVIRDGGGQ SLNGLAVNTT
strain B171             GQWIQNGGIA GNTTVTTNGR QVVLEGGTAS DTVIRDGGGQ SLNGLAVNTT
strain E22              GQWIQNGGIA GNTTVTTNGR QVVLEGGTAS DTVIRDGGGQ SLNGLAVNTT
strain B171             GQWIQNGGIA NNTTVTGGGL QRVNAGGSVS DTVISAGGGQ SLQGQAVNTT
strain B171             GQWIQNGGIA NNTTVTGGGL QRVNAGGSVS DTVISAGGGQ SLQGQAVNTT
strain E24377A and O42  GQWIQNGGIA NNTTVTGGGL QRVNAGGSVS DTVISAGGGQ SLQGQAVNTT
```

```
                                       -continued
strain E24377A           GQWIQNGGIA NNTTVTGGGL QRVNAGGSVS DTVISAGGGQ SLQGQAVNTT
Group B                  GQWIQNGGIA NNTTVTGGGL QRVNAGGSVS DTVISAGGGQ SLQGQAVNTT
strain E110019           GQWIQNGGIA NNTTVTGGGL QRVNAGGSVS DTVISAGGGQ SLQGQAVNTT
strain E22               GQWIQNGGTA NNTTVTGGGL QRVNTGGSVS DTVISAGGGQ SLQGQAVNTT
strain H10407            GQWIQNGGIA NNTTVTGGGL QRVNAGGSVS DTVISAGGGQ SLQGQAVNTT
strain F11 and 536       GQWIQNGGIA NNTTVTGGGL QRVNAGGSVS DTVISAGGGQ SLQGQAVNTT
strain SECEC             GQWVQDGGTA SNTTISSGGL QFVGAGGKAT DTIINEGGGQ SLKGLALNTT
strain H10407            GQWVQDGGTA SNTTISSGGL QFVGAGGKAT DTIINEGGGQ SLKGLALNTT
strain W3110 and DH10B   GQWVQDGGTA NKTTVTSGGL QRVNPGGSVS DTVISAGGGQ SLQGRAVNTT
strain MG1655            GQWVQDGGTA NKTTVTSGGL QRVNPGGSVS DTVISAGGGQ SLQGRAVNTT
strain O42               GQWVQDGGTA NKTTVTSGGL QRVNPGGSVS DTVISAGGGQ SLQGRAVNTT
strain B7A               GQWIQNGGIA NNTTVTGGGL QRVNAGGSVS DTVISAGGGQ SLQGQAVNTT
strain CFT073            GQQIARGGTA RNTRVTANGL QDVMAGGSTS DTVISTGGGQ NLRGKASGTV
strain O42               GQQIARGGTA RNTTVTANGL QDVMAGGSAT DTVISAGGGQ NLRGQAYGTV
strain CFT073            GQWIKAGGTG RNTTVTANGR QIVQAGGTAS DTVIRDGGGQ SLNGLAVNTT
Consensus                GQ----GG-- --T-----G- Q-V--GG--- DT-I-GGGQ -L-G-A--T-
B-Cell Ep.               ********** ********** ********** ********** *****

151                                                200
strain E110019           LNNRGEQWVH EGGVATGTII NRDGYQSVKS GGLATGTIIN TGAEGGPDSD
Group A                  LNNRGEQWVH EGGVATGTII NRDGYQSVKS GGLATGTIIN TGAEGGPDSD
strain B171              LNNRGEQWVH EGGVATGTII NRDGYQSVKS GGLATGTIIN TGAEGGPDSD
strain E22               LNNRGEQWVH EGGVATGTII NRDGYQSVKS GGLATGTIIN TGAEGGPDSD
strain B171              LNG.GEQWVH EGGIATGTVI NEKGWQAVKS GAMATDTVVN TGAEGGPDAE
strain B171              LNG.GEQWVH EGGIATGTVI NEKGWQAVKS GAMATDTVVN TGAEGGPDAE
strain E24377A and O42   LNG.GEQWVH EGGIATGTVI NEKGWQAVKS GAMATDTVVN TGAEGGPDAE
strain E24377A           LNG.GEQWVH EGGIATGTVI NEKGWQAVKS GAMATDTVVN TGAEGGPDAE
Group B                  LNG.GEQWVH EGGIATGTVI NEKGWQAVKS GAMATDTVVN TGAEGGPDAE
strain E110019           LNG.GEQWVH EGGIATVTVI NEKGWQAVKS GAMATDTVVN TGAEGGPDAD
strain E22               LNG.GEQWVH EGGIATGTVI NEKGWQAIKS GAVATDTVVN TGAEGGPDAE
strain H10407            LNG.GEQWVH EGGIATGTVI NEKGWQAVKS GAMATDTVVN TGAEGGPDAE
strain F11 and 536       LNG.GEQWVH EGGIATGTVI NEKGWQAVKS GAMATDTVVN TGAEGGPDAE
strain SECEC             LNG.GEQWMH EGAIATGTVI NDKGWQVVKP GAVATDTVVN TGAEGGPDAE
strain H10407            LNG.GEQWMH EGAIATGTVI NDKGWQVVKP GAVATDTVVN TGAEGGPDAE
strain W3110 and DH10B   L.NGGEQWMH EGAIATGTVI NDKGWQVVKP GTVATDTVVN TGAEGGPDAE
strain MG1655            L.NGGEQWMH EGAIATGTVI NDKGWQVVKP GTVATDTVVN TGAEGGPDAE
strain O42               L.NGGEQWMH EGAIATGTVI NDKGWQVVKP GTVATDTVVN TGAEGGPDAE
strain B7A               L.NGGEQWVH EGGIATGTVI NEKGWQAIKS GAVATDTVVN TGAEGGPDAE
strain CFT073            L.NGGDQWTH AGGRASGTVI NQDGYQTIKH GGLVTGTIVN TGAEGGPDSE
strain O42               L.NGGEQWTH AGGSASGTVI NQSGYQTIKH GGQATGTIVN TGAEGGPESE
strain CFT073            LDNRGEQWVH GGGKAAGTII NQDGYQTIKH GGLATGTIVN TGAEGGPESE
Consensus                L---G-QW-H -G--A--T-I N--G-Q--K- G---T-T--N TGAEGGP---
B-Cell Ep.                                                 **************************

201                                                250
strain E110019           NSYTGQKVQG TAESTTINKN GRQIILFSGL ARDTLIYAGG DQSVHGRALN
Group A                  NSYTGQKVQG TAESTTINKN GRQIILFSGL ARDTLIYAGG DQSVHGRALN
strain B171              NSYTGQKVQG TAESTTINKN GRQIILFSGI ARDTLIYAGG DQSVHGRALN
strain E22               NSYTGQKVQG TAESTTINKN GRQIILFSGI ARDTLIYAGG DQSVHGRALN
strain B171              NGDTGQFVRG NAVRTTINKN GRQIVAAEGT ANTTVVYAGG DQTVHGHALD
strain B171              NGDTGQFVRG NAVRTTINKN GRQIVAAEGT ANTTVVYAGG DQTVHGHALD
strain E24377A and O42   NGDTGQFVRG NAVRTTINEN GRQIVAAEGT ANTTVVYAGG DQTVHGHALD
strain E24377A           NGDTGQFVRG NAVRTTINKN GRQIVAAEGT ANTTVVYAGG DQTVHGHALD
Group B                  NGDTGQTVYG DAVRTTINKN GRQIVAAEGT ANTTVVYAGG DQTVHGHALD
strain E110019           NGDTGQFVRG NAVRTTINEN GRQIVAVEGT ANTTVVYAGG DQTVHGHALD
strain E22               NGDTGQTVYG DAVRTTINKN GRQIVAAEGT ANTTVVYAGG DQTVHGHALD
strain H10407            NGDTGQFVRG NAVRTTINKN GRQIVAAEGT ANTTVVYAGG DQTVHGHALD
strain F11 and 536       NGDTGQFVRG NAVRTTINEN GRQIVAAEGT ANTTVVYAGG DQTVHGYALD
strain SECEC             NGDTGQFVRG NAVRTTINKN GRQIVTVEGT ANTTVVYAGG DQTVHGHALD
strain H10407            NADTGQFVRG DAVRTTINKN GRQIVVATGV ANTTVVYAGG DQTVHGYALD
strain W3110 and DH10B   NGDTGQFVRG DAVRTTINKN GRQIVRAEGT ANTTVVYAGG DQTVHGHALD
strain MG1655            NGDTGQFVRG DAVRTTINKN GRQIVRAEGT ANTTVVYAGG DQTVHGHALD
strain O42               NGDTGQFVRG NAVRTTINKN GRQIVRAEGT ANTTVVYAGG DQTVHGHALD
strain B7A               NGDTGQTVYG DAVRTTINKN GRQIVAAEGT ANTTVVYAGG DQTVHGHALD
strain CFT073            NVSTGQMVGG IAESTTINKN GRQVIWSSGI ARDTLIYTGG DQTVHGEAHN
strain O42               NVSSGQMVGG TAESTTINKN GRQVIWSSGM ARDTLIYAGG DQTVHGEAHN
strain CFT073            NVSSGQMVGG TAESTTINKN GRQVIWSSGM ARDTLIYAGG DQTVHGEAHN
Consensus                N---GQ-V-G -A--TTIN-N GRQ-----G- A--T--Y-GG DQ-VHG-A-
B-Cell Ep.               ********   *********   ***** ***   **** ******

251                                                300
strain E110019           TTLNGGYQYV HRDGLALNTV INEGGWQVVK AGGAAGNTTI NQNGELRVHA
Group A                  TTLNGGYQYV HRDGLALNTV INEGGWQVVK AGGAAGNTTI NQNGELRVHA
strain B171              TTLNGGYQYV HKDGLALNTV INEGGWQVVK AGGAVGNTTI NQNGELRVHA
strain E22               TTLNGGYQYV HKDGLALNTV INEGGWQVVK AGGAVGNTTI NQNGELRVHA
strain B171              TTLNGGYQYV HNGGTASGTV VNSDGWQIIK EGGLADFTTV NQKGKLQVNA
strain B171              TTLNGGYQYV HNGGTASGTV VNSDGWQIIK EGGLADFTTV NQKGKLQVNA
strain E24377A and O42   TTLNGGYQYV HNGGTASDTV VNSDGWQIVK EGGLADFTTV NQKGKLQVNA
strain E24377A           TTLNGGYQYV HNGGTASGTV VNSDGWQIIK EGGLADFTTV NQKGKLQVNA
Group B                  TTLNGGYQYV HNGGTASDTV VNSDGWQIIK EGGLADFTTV NQKGKLQVNA
strain E110019           TTLNGGYQYV HNGGTASDTV VNSDGWQIVK EGGLADFTTV NQKGKLQVNA
```

-continued
```
strain E22                   TTLNGGYQYV HNGGTASGTV VNSDGWQIIK EGGLADFTTV NQKGKLQVNA
strain H10407                TTLNGGYQYV HNGGTASGTV VNSDGWQIIK EGGLADFTTV NQKGKLQVNA
strain F11 and 536           TTLNGGNQYV HNGGTASGTV VNSDGWQIVK EGGLADFTIV NQKGKLQVNA
strain SECEC                 TTLNGGNQYV HNGGTTSDTV VNSDGWQIIK EGGLADFTTV NQKGKLQVNA
strain H10407                TTLNGGYQYV HNGGTASDTV VNSDGWQIIK EGGLADFTTV NQKGKLQVNA
strain W3110 and DH10B       TTLNGGYQYV HNGGTASDTV VNSDGWQIVK NGGVAGNTTV NQKGRLQVDA
strain MG1655                TTLNGGYQYV HNGGTASDTV VNSDGWQIVK NGGVAGNTTV NQKGRLQVDA
strain O42                   TTLNGGYQYV HNGGTASDTV VNSDGWQIVK NGGVAGNTTV NQKGRLQVDA
strain B7A                   TTLNGGYQYV HNGGTASGTV VNSDGWQIVK NGGVAGNTTV NQKGRLQVDA
strain CFT073                TRLEGGNQYV HKYGLALNTV INEGGWQVVK AGGTAGNTTI NQNGELRVHA
strain O42                   TRLEGGNQYV HKYGLALNTV INEGGWQVVK EGGTTAHTTI NQKGKLQVNA
strain CFT073                TRLEGGNQYV HNGGTATETL INRDGWQVIK EGGTAAHTTI NQKGKLQVNA
Consensus                    T-L-GG-QYV H--G----T- -N--GWQ--K -GG----T-- NQ-G-L-V-A
B-Cell Ep.                              ***  **********  ***              **********  ***  ******

301                                                 350
strain E110019               GGEATAVTQN TGGALVTSTA ATVIGTNRLG NFTVENGKAD GVVLESGGRL
Group A                      GGEATAVTQN TGGALVTSTA ATVIGTNRLG NFTVENGKAD GVVLESGGRL
strain B171                  GGEATAVTQN TGGALVTSTA ATVTGANRLG HFSVGNGMAD NVVLENGGRL
strain E22                   GGEATAVTQN TGGALVTSTA ATVTGANRLG HFSVGNGMAD NVVLENGGRL
strain B171                  GGTATHVTLK QGGALVTSTA ATVLGSNRLG NFTVENGKAD GVVLESGGRL
strain B171                  GGTATHVTLK QGGALVTSTA ATVTGSNRLG NFTVENGKAD GVVLESGGRL
strain E24377A and O42       GGTATNVTLK QGGALVTSTA ATVTGSNRLG NFTVENGNAD GVVLESGGRL
strain E24377A               GGTATNVTLK QGGALVTSTA ATVTGSNRLG NFTVENGKAD GVVLESGGRL
Group B                      GGTATNVTLT QGGALVTSTA ATVTGSNRLG NFTVENGNAD GVVLESGGRL
strain E110019               GGTATNVTLK QGGALVTSTA ATVTGSNRLG NFTVENGNAD GVVLESGGRL
strain E22                   GGTATNVTLK QGGALVTSTA ATVLGSNRLG NFTVENGKAD GVVLESGGRL
strain H10407                GGTATNVTLK QGGALVTSTA ATVLGSNRLG NFTVENGKAD GVVLESGGRL
strain F11 and 536           GGTATNVTLK QGGALVTSTA ATVTGSNRLG NFTVENGNAD GVVLESGGRL
strain SECEC                 GGTATNVTLK QGGALVTSTA ATVTGSNRLG NFAVENGKAD GVVLESGGRL
strain H10407                GGTATNVTLK QGGALVTSTA ATVLGSNRLG NFTVENGKAD GVVLESGGRL
strain W3110 and DH10B       GGTATNVTLK QGGALVTSTA ATVTGINRLG AFSVVEGKAD NVVLENGGRL
strain MG1655                GGTATNVTLK QGGALVTSTA ATVTGINRLG AFSVVEGKAD NVVLENGGRL
strain O42                   GGTATNVTLK QGGALVTSTA ATVTGINRLG AFSVVEGKAD NVVLENGGRL
strain B7A                   GGTATNVTLK QGGALVTSTA ATVTGINRLG AFSVVEGKAD NVVLENGGRL
strain CFT073                GGEASDVTQN TGGALVTSTA ATVTGTNRLG AFSVVEGKAD NVVLENGGRL
strain O42                   GGKASDVTQN TGGALVTSTA ATVTGTNRLG AFSVLAGKAD NVVLENGGRL
strain CFT073                GGKASDVTQN TGGALVTSTA ATVTGTNRLG AFSVVAGKAD NVVLENGGRL
Consensus                    GG-A--VT-- -GGALVTSTA ATV-G-NRLG -F-V--G-AD -VVLE-GGRL
                                        SEQ ID NO: 308
B-Cell Ep.                   **********

351                                                 400
strain E110019               DVLESHSAQN TLVDDGGTLA VSAGGKATSV TITSGGALIA DSGATVEGTN
Group A                      DVLESHSAQN TLVDDGGTLA VSAGGKATSV TITSGGALIA DSGATVEGTN
strain B171                  DVLEGHSAQN TLVDDGGTLA VSAGGKATDV TMTSGGALIA DSGATVEGTN
strain E22                   DVLEGHSAQN TLVDDGGTLA VSAGGKATDV TMTSGGALIA DSGATVEGTN
strain B171                  DVLEGHSAQK TRVDDGGTLA VSAGGKATDV TMTSGSALIA DSGATVEGTN
strain B171                  DVLEGHSAQK TRVDDGGTLA VSAGGKATDV TMTSGSALIA DSGATVEGTN
strain E24377A and O42       DVLEGHSAWK TLVDDGGTLA VSAGGKATDV TMTSGSALIA DSGATVEGTN
strain E24377A               DVLEGHSAWK TLVDDGGTLA VSAGGKATDV TMTSGSALIA DSGATVEGTN
Group B                      DVLEGHSAWK TLVDDGGTLA VSAGGKATDV TMTSGGALIA DSGATVEGTN
strain E110019               DVLEGHSAWK TRVDDGGTLA VSAGGKATGV TMTSGGALIA DSGATVEGTN
strain E22                   DVLEGHSAWK TLVDDGGTLA VSAGGKATGV TMTSGGALIA DSGATVEGTN
strain H10407                DVLEGHSAWK TRVDDGGTLA VSAGGKATGV TMTSGGALIA DSGATVEGTN
strain F11 and 536           DVLEGHSAWK TLVDDGGTLA VSAGGKATDV TMTSGGALIA DSGATVEGTN
strain SECEC                 DVLEGHSAQK TRVDDGGTLA VSAGGKATGV TMTSGGALIA DSGATVEGTN
strain H10407                DVLEGHSAWK TLVDDGGILA VSAGGKATDV TMTSGGALIA DSGATVEGTN
strain W3110 and DH10B       DVLTGHTATN TRVDDGGTLD VRNGGTATTV SMGNGGVLLA DSGAAVSGTR
strain MG1655                DVLTGHTATN TRVDDGGTLD VRNGGTATTV SMGNGGVLLA DSGAAVSGTR
strain O42                   DVLTGHTATN TRVDDGGTLD VRNGGTATTV SMGNGGVLLA DSGAAVSGTR
strain B7A                   DVLTGHTATN TRVDDGGTLD VRNGGTATTV SMGNGGVLLA DSGAAVSGTR
strain CFT073                DVLSGHTATR TLVDDGGTLD VRNGGTATAV SMGNGGVLLA DSGAAVSGTR
strain O42                   DVLSGHTATN TRVDDGGTLD VRNGGAATTV SMGNGGVLLA DSGAAVSGTR
strain CFT073                DVLSGHTATN TRVDDGGTLD IRNGGAATTV SMGNGGVLLA DSGAAVSGTR
Consensus                    DVL--H-A-- T-VDDGG-L- ---GG-AT-V ----G--L-A DSGA-V-GT-
B-Cell Ep.                        *****  **********  **********  ***            ********

401                                                 450
strain E110019               ASGK.FSIDG TSGQASGLLL ENGGSFTVNA GGQAGNTTVG HRGTLTLAAG
Group A                      ASGK.FSIDG TSGQASGLLL ENGGSFTVNA GGQAGNTTVG HRGTLTLAAG
strain B171                  ASGK.FSIDG ISGQASGLLL ENGGSFTVNA GGQAGNTTVG HRGTLTLAAG
strain E22                   ASGK.FSIDG TSGQASGLLL ENGGSFTVNA GGQAGNTTVG HRGTLTLAAG
strain B171                  ASGK.FSIDG ISGQASGLLL ENGGSFTVNA GGLASNTTVG HRGTLTLAAG
strain B171                  ASGK.FSIDG TSGQASGLLL ENGGSFTVNA GGLASNTTVG HRGTLTLAAG
strain E24377A and O42       ASGK.FSIDG ISGQASGLLL ENGGSFTVNA GGLASNTTVG HRGTLTLAAG
strain E24377A               ASGK.FSIDG TSGQASGLLL ENGGSFTVNA GGLASNTTVG HRGTLTLAAG
Group B                      ASGK.FSIDG ISGQASGLLL ENGGSFTVNA GGLASNTTVG HRGTLTLAAG
strain E110019               ASGK.FSIDG ISGQASGLLL ENGGSFTVNA GGQASNTTVG HRGTLMLAAG
strain E22                   ASGK.FSIDG ISGQASGLLL ENGGSFTVNA GGQASNTTVG HRGTLMLAAG
strain H10407                ASGK.FSIDG TSGQASGLLL ENGGSFTVNA GGQASNTTVG HRGTLMLAAG
```

-continued

```
strain F11 and 536      ASGK.FSIDG ISGQASGLLL ENGGSFTVNA GGQAGNTTVG HRGTLTLAAG
strain SECEC            ASGK.FSIDG ISGQASGLLL ENGGSFTVNA GGQAGNTTVG HRGTLTLAAG
strain H10407           ASGK.FSIDG ISGQASGLLL ENGGSFTVNA GGQAGNTTVG HRGTLTLAAG
strain W3110 and DH10B  SDGKAFSIGG ..GQADALML EKGSSFTLNA GDTATDTTV. .NGGLFTARG
strain MG1655           SDGKAFSIGG ..GQADALML EKGSSFTLNA GDTATDTTV. .NGGLFTARG
strain O42              SDGKAFSIGG ..GQADALML EKGSSFTLNA GDTATDTTV. .NGGLFTARG
strain B7A              SDGKAFSIGG ..GQADALML EKGSSFTLNA GDTATDTTV. .NGGLFTARG
strain CFT073           SDGTAFRIGG ..GQADALML EKGSSFTLNA GDTATDTTV. .NGGLFTARG
strain O42              SDGTAFRIGG ..GQADALML EKGSSFTLNA GDTATDTTV. .NGGLFTARG
strain CFT073           SDGKAFSIGG ..GQADALML EKGSSFTLNA GDTATDTTV. .NGGLFTARG
Consensus               --G--F-I-G --GQA--L-L E-G-SFT-NA G--A--TTV- --G-L--A-G
B-Cell Ep.              **********            ****  *********

451                                                  500
strain E110019          GSLSGRTQLS KGASMVLNGD VVST....... .GDIV..... ..........
Group A                 GSLSGRTQLS KGASMVLNGD VVST....... .GDIV..... ..........
strain B171             GSLSGRTQLS KGASMVLNGD VVST....... .GDIV..... ..........
strain E22              GSLSGRTQLS KGASMVLNGD VVST....... .GDIV..... ..........
strain B171             GSLSGRTQLS KGASMVLNGD VVST....... .GDIV..... ..........
strain B171             GSLSGRTQLS KGASMVLNGD VVST....... .GDIV..... ..........
strain E24377A and O42  GSLSGRTQLS KGASMVLNGD VVST....... .GDIV..... ..........
strain E24377A          GSLSGRTQLS KGASMVLNGD VVST....... .GDIV..... ..........
Group B                 GSLSGRTQLS KGASMVLNGD VVST....... .GDIV..... ..........
strain E110019          GSLSGRTQLS KGASMVLNGD VVST....... .GDIV..... ..........
strain E22              GSLSGRTQLS KGASMVLNGD VVST....... .GDIV..... ..........
strain H10407           GSLSGRTQLS KGASMVLNGD VVST....... .GDIV..... ..........
strain F11 and 536      GSLSGRTQLS KGASMVLNGD VVST....... .GDIV..... ..........
strain SECEC            GSLSGRTQLS KGASMVLNGD VVST....... .GDIV..... ..........
strain H10407           GSLSGRTQLS KGASMVLNGD VVST....... .GDIV..... ..........
strain W3110 and DH10B  GTLAGTTTLN NGAILTLSGK TVNNDTLTIR EGDALLQGGS LTGNGSVEKS
strain MG1655           GTLAGTTTLN NGAILTLSGK TVNNDTLTIR EGDALLQGGS LTGNGSVEKS
strain O42              GTLAGTTTLN NGAILTLSGK TVNNDTLTIR EGDALLQGGS LTGNGSVEKS
strain B7A              GTLAGTTTLN NGAILTLSGK TVNNDTLTIR EGDALLQGGS LTGNGSVEKS
strain CFT073           GSLAGTTTLN NGATFTLAGK TVNNDTLTIR EGDALLQGGA LTGNGRVEKS
strain O42              GSLAGTTTLN NGATLTLSGK TVNNDTLTIR EGDALLQGGS LTGNGRVEKS
strain CFT073           GTLAGTTTLN NGAILTLSGK TVNNDTLTIR EGDALLQGGS LTGNGSVEKS
Consensus               G-L-G-T-L- -GA---L-G- -V-------- -GD------- ----------
B-Cell Ep.              **********                           **********

501                                                  550
strain E110019          NAGEIRFDNQ T.TPNAA.LS R.AVAKSNSP VTFH....... ...KLTTT..
Group A                 NAGEIRFDNQ T.TPNAA.LS R.AVAKSNSP VTFH....... ...KLTTT..
strain B171             NAGEIRFDNQ T.TQDAV.LS R.AVAKGDSP VTFH....... ...KLTTN..
strain E22              NAGEIRFDNQ T.TQDAV.LS R.AVAKGDSP VTFH....... ...KLTTS..
strain B171             NAGEIRFDNQ T.TQDAV.LS R.AVAKGDSP VTFH....... ...KLTTS..
strain B171             NAGEIRFDNQ T.TQDAV.LS R.AVAKGDSP VTFH....... ...KLTTS..
strain E24377A and O42  NAGEIRFDNQ T.TPDAA.LS R.AVAKGDSP VTFH....... ...KLTTS..
strain E24377A          NAGEIRFDNQ T.TPDAV.LS R.AVAKGDSP VTFH....... ...KLTTS..
Group B                 NAGEIRFDNQ T.TPDAA.LS R.AVAKGDSP VTFH....... ...KLTTS..
strain E110019          NAGEIYFDNQ T.TPDAV.LS R.AVAKGNAP VTFH....... ...KLTTS..
strain E22              NAGEIYFDNQ T.TPDAV.LS R.AVAKGNAP VTFH....... ...KLTTS..
strain H10407           NAGEIHFDNQ T.TQDAV.LS R.AVAKSNSP VTFH....... ...KLTTT..
strain F11 and 536      NAGEIHFDNQ T.TPDAA.LS R.AVAKGDSP VTFH....... ...KLTTS..
strain SECEC            NAGEIRFDNQ T.TQDAV.LS R.AVAKGDAP VTFH....... ...KLTTS..
strain H10407           NAGEIHFDNQ T.TQDAV.LS R.AVAKSNSP VTFH....... ...KLTTT..
strain W3110 and DH10B  GSGTLTVSNT TLTQKAVNLN EGTLTLNDST VTTDVIAQRG TALKLTGSTV
strain MG1655           GSGTLTVSNT TLTQKAVNLN EGTLTLNDST VTTDVIAQRG TALKLTGSTV
strain O42              GSGTLTVSNT TLTQKAVNLN EGTLTLNDST VTTDVIAQRG TALKLTGSTV
strain B7A              GSGTLTVSNT TLTQKAVNLN EGTLTLNDST VTTDVIAQRG TALKLTGSTV
strain CFT073           GSGTLTVSNT TLTQKAVNLN EGTLTLNDST VTTDITAHRG TALKLTGSTV
strain O42              GSGTLTVSNT TLTQKTVNLN EGTLTLNDST VTTDVIAQRG TALKLTGSTV
strain CFT073           GSGTLTVSNT TLTQKAVNLN EGTLTLNDST VTTDVIAQRG TALKLTGSTV
Consensus               --G-----N- T-T-----L- ---------- VT-------- ---KLT----
B-Cell Ep.              *******

551                                                  600
strain E110019          .......... .......... .......... .......... ..........
Group A                 .......... .......... .......... .......... ..........
strain B171             .......... .......... .......... .......... ..........
strain E22              .......... .......... .......... .......... ..........
strain B171             .......... .......... .......... .......... ..........
strain B171             .......... .......... .......... .......... ..........
strain E24377A and O42  .......... .......... .......... .......... ..........
strain E24377A          .......... .......... .......... .......... ..........
Group B                 .......... .......... .......... .......... ..........
strain E110019          .......... .......... .......... .......... ..........
strain E22              .......... .......... .......... .......... ..........
strain H10407           .......... .......... .......... .......... ..........
strain F11 and 536      .......... .......... .......... .......... ..........
strain SECEC            .......... .......... .......... .......... ..........
strain H10407           .......... .......... .......... .......... ..........
```

-continued

```
                           601                                                     650
strain E110019          .......NLT GQGGTINMRV RLD.GSNASD QLVINGGQAT GKTWLAFTNV
Group A                 .......NLT GQGGTINMRV RLD.GSNASD QLVINGGQAT GKTWLAFTNV
strain B171             .......NLT GQGGTINMRV RLD.GSNASD QLVINGGQAT GKTWLAFTNV
strain E22              .......NLT GQGGTINMRV RLD.GSNASD QLVINGGQAT GKTWLAFTNV
strain B171             .......NLT GQGGTINMRV RLD.GSNTSD QLVINGGQAT GKTWLAFTNV
strain B171             .......NLT GQGGTINMRV RLD.GSNTSD QLVINGGQAT GKTWLAFTNV
strain E24377A and O42  .......NLT GQGGTINMRV RLD.GSNASD QLVINGGQAT GKTWLAFTNV
strain E24377A          .......NLT GQGGTINMRV RLD.GSNTSD QLVINGGQAT GKTWLAFTNV
Group B                 .......NLT GQGGTINMRV RLD.GSNASD QLVINGGQAT GKTWLAFTNV
strain E110019          .......NLT GQGGTINMRV RLD.GSNASD QLVINGGQAT GKTWLAFTNV
strain E22              .......NLT GQGGTINMRV RLD.GSNTSD QLVINGGQAT GKTWLAFTNV
strain H10407           .......NLT GQGGTINMRV SLD.GSNASD QLVINGGQAT GKTWLAFTNV
strain F11 and 536      .......NLT GQGGTINMRV RLD.GSNTSD QLVINGGQAT GKTWLAFTNV
strain SECEC            .......NLT GQGGTINMRV RLD.GSNASD QLVINGGQAT GKTWLAFTNV
strain H10407           .......NLT GQGGTINMRV SLD.GSNASD QLVINGGQAT GKTWLAFTNV
strain W3110 and DH10B  PATLKVKNLN GQNGTISLRV RPDMAQNNAD RLVIDGGRAT GKTILNLVNA
strain MG1655           PATLKVKNLN GQNGTISLRV RPDMAQNNAD RLVIDGGRAT GKTILNLVNA
strain O42              PATLKVKNLN GQNGTISLRV RPDMAQNNAD RLVIDGGRAT GKTILNLVNA
strain B7A              PATLKVKNLN GQNGTISLRV RPDMAQNNAD RLVIDGGRAT GKTILNLVNA
strain CFT073           PTTLQVKNLN GQNGTISLRV RPDMAQNNAD RLVIDGGRAT GKTILNLVNA
strain O42              PATLQVKNLN GQNGTISLRV RPDMAQNNAD RLVIDGGRAT GKTILNLVNA
strain CFT073           PATLKVKNLN GQNGTISLRV RPDMAQNNAD RLVIDGGRAT GKTILNLVNA
Consensus               -------NL- GQ-GTI--RV --D---N--D -LVI-GG-AT GKT-L---N-
B-Cell Ep.                     ** ****           ******                       *

651                                                     700
strain E110019          GNSNLGVATT GQGIRVVDAQ NGATTEEGAF ALSRPLQAGA FNYTLNRDSD
Group A                 GNSNLGVATT GQGIRVVDAQ NGATTEEGAF ALSRPLQAGA FNYTLNRDSD
strain B171             GNSNLGVATS GQGIRVVDAQ NGATTEEGAF ALSRPLQAGA FNYTLNRDSD
strain E22              GNSNLGVATS GQGIRVVDAQ NGATTEESAF ALSRPLHAGA FNYTLNRDSD
strain B171             GNSNLGVATS GQGIRVVDAQ NGATTEEGAF ALSRPLQAGA FNYTLNRDSD
strain B171             GNSNLGVATS GQGIRVVDAQ NGATTEEGAF ALSRPLQAGA FNYTLNRDSD
strain E24377A and O42  GNSNLGVATS GQGIRVVDAQ NGATTEEGAF ALSRPLQAGA FNYTLNRDSD
strain E24377A          GNSNLGVATS GQGIRVVDAQ NGATTEEGAF ALSRPLQAGA FNYTLNRDSD
Group B                 GNSNLGVATS GQGIRVVDAQ NGATTEEGAF ALSRPLQAGA FNYTLNRDSD
strain E110019          GNSNLGVATT GQGIRVVDAQ NGATTEEGVF ALSRPLQAGA FNYTLNRDSD
strain E22              GNSNLGVATS GQGIRVVDAQ NGATTEEGAF ALSRPLQAGA FNYTLNRDSD
strain H10407           GNSNLGVATS GQGIRVVDAQ NGATTEEGAF ALSRPLQAGA FNYTLNRDSD
strain F11 and 536      GNSNLGVATT GQGIRVVDAQ NGATTEEGAF ALSRPLQAGA FNYTLNRDSD
strain SECEC            GNSNLGVATS GQGIRVVDAQ NGATTEEGAF ALSRPLQAGA FNYTLNRDSD
strain H10407           GNSNLGVATS GQGIRVVDAQ NGATTEEGAF ALSRPLQAGA FNYTLNRDSD
strain W3110 and DH10B  GNSASGLATS GKGIQVVEAI NGATTEEGAF VQGNRLQAGA FNYSLNRDSD
strain MG1655           GNSASGLATS GKGIQVVEAI NGATTEEGAF VQGNRLQAGA FNYSLNRDSD
strain O42              GNSASGLATS GKGIQVVEAI NGATTEEGAF VQGNRLQAGA FNYSLNRDSD
strain B7A              GNSASGLATS GKGIQVVEAI NGATTEEGAF IQGNKLQAGA FNYSLNRDSD
strain CFT073           GNSGTGLATT GKGIQVVEAI NGATTEEGAF VQGNMLQAGA FNYTLNRDSD
strain O42              GNSGTGLATT GKGIQVVEAI NGATTEEGAF VQGNMLQAGA FNYTLNRDSD
strain CFT073           GNSASGLATS GKGIQVVEAI NGATTEEGAF VQGNRLQAGA FNYSLNRDSD
Consensus               GNS--G-AT- G-GI-VV-A- NGATTEE--F -----L-AGA FNY-LNRDSD
B-Cell Ep.              ********** ***            ********** *

701                                                     750
strain E110019          EDWYLRSENA YRAEVPLYTS MLTQAMDYDR ILAGSRSHQT GVNGENNSVR
Group A                 EDWYLRSENA YRAEVPLYTS MLTQAMDYDR ILAGSRSHQT GVNGENNSVR
strain B171             EDWYLRSENA YRAEVPLYAS MLTQAMDYDR ILAGSRSHQT GVNGENNSVR
strain E22              EDWYLRSENA YRAEVPLYAS MLTQAMDYDR ILAGSRSHQS GVSGENNSVR
strain B171             EDWYLRSENA YRAEVPLYAS MLTQAMDYDR ILAGSRSHQT GVNGENNSVR
strain B171             EDWYLRSENA YRAEVPLYAS MLTQAMDYDR ILAGSRSHQT GVNGENNSVR
strain E24377A and O42  EDWYLRSENA YRAEVPLYTS MLTQAMDYDR ILAGSRSHQT GVNGENNSVR
strain E24377A          EDWYLRSENA YRAEVPLYAS MLTQAMDYDR ILAGSRSHQT GVSGENNSVR
Group B                 EDWYLRSENA YRAEVPLYAS MLTQAMDYDR ILAGSRSHQS GVSGENNSVR
strain E110019          EDWYLRSENA YRAEVPLYTS MLTQAMDYDR ILAGSRSHQT GVNGENNSVR
strain E22              EDWYLRSENA YRAEVPLYAS MLTQAMDYDR ILAGSRSHQS GVSGENNSVR
strain H10407           EDWYLRSENA YRAEVPLYTS MLTQAMDYDR ILAGSRSHQT GVNGENNSVR
strain F11 and 536      EDWYLRSENA YRAEVPLYAS MLTQAMDYDR ILAGSRSHQT GVNGENNSFR
strain SECEC            EDWYLRSENA YRAEVPLYTS MLTQAMDYDR ILAGSRSHQT GVNGENNSVR
strain H10407           EDWYLRSENA YRAEVPLYTS MLTQAMDYDR ILAGSRSHQT GVNGENNSVR
strain W3110 and DH10B  ESWYLRSENA YRAEVPLYAS MLTQAMDYDR IVAGSRSHQT GVNGENNSVR
strain MG1655           ESWYLRSENA YRAEVPLYAS MLTQAMDYDR IVAGSRSHQT GVNGENNSVR
strain O42              ESWYLRSENA YRAEVPLYAS MLTQAMDYDR ILAGSRSHQT GVSGENNSVR
``` strain W3110 and DH10B    LNGAIDPTNV TLASGATWNI PDNATVQSVV DDLSHAGQIH FTSTRTGKFV
strain MG1655             LNGAIDPTNV TLASGATWNI PDNATVQSVV DDLSHAGQIH FTSTRTGKFV
strain O42                LNGAIDPTNV TLASGATWNI PDNATVQSVV DDLSHAGQIH FTSTRTGKFV
strain B7A                LNGAIDPTNV TLASGATWNI PDNATVQSVV DDLSHAGQIH FTSTRTGKFV
strain CFT073             LNGAIDPTNV TLTSGATWNI PDNATVQSVV DDLSHAGQIH FTSARTGKFV
strain O42                LNGAIDPTNV TLTSGATWNI PDNATVQSVV DDLSHAGQIH FTSTRTGKFV
strain CFT073             LNGAIDPTNV TLASGATWNI PDNATVQSVV DDLSHAGQIH FTSSRTGTFV
Consensus                 ---------- ---------- ---------- ---------- ----------
B-Cell Ep.                *****       ** ***         ****

```
                                                  -continued
strain B7A                  ESWYLRSENA YRAEVPLYAS MLTQAMDYDR ILAGSRSHQT GVSGENNSVR
strain CFT073               ESWYLRSEER YRAEVPLYAS MLTQAMDYDR ILAGSRSHQT GVNGENNSVR
strain O42                  ESWYLRSEER YRAEVPLYAS MLTQAMDYDR ILAGSRSHQT GVNGENNSVR
strain CFT073               ESWYLRSENA YRAEVPLYAS MLTQAMDYDR ILAGSRSHQT GVNGENNSVR
Consensus                   E-WYLRSE-- YRAEVPLY-S MLTQAMDYDR I-AGSRSHQT GVnGENNS-R
                                                  SEQ ID NO: 309   SEQ ID NO: 310-313
B-Cell Ep.                  ****                                   ****** ********

751                                                  800
strain E110019              LSIQGGHLGH DNNGGIARGA TPESSGSYGF VRLEGDLLRT EVAGMSLTTG
Group A                     LSIQGGHLGH DNNGGIARGA TPESSGSYGF VRLEGDLLRT EVAGMSLTTG
strain B171                 LSIQGGHLGH DNNGGIARGA TPESSGSYGL VRLEGDLLRT EVAGMSLTTG
strain 522                  LSIQGGHLGH DNNGGIARGA TPESNGSYGF VRLEGDLLRT EVAGMSLTTG
strain 8171                 LSIQGGHLGH DNNGGIARGA TPESNGSYGF VRLEGDLLRT EVAGMSLTTG
strain 8171                 LSIQGGHLGH DNNGGIARGA TPESNGSYGF VRLEGDLLRT EVAGMSLTTG
strain E24377A and O42      LSIQGGHLGH DNNGGIARGA TPESSGSYGF VRLEGDLLRT EVAGMSLTTG
strain E24377A              LSIQGGHLGH DNNGGIARGA TPESSGSYGF VRLEGDLLRT EVAGMSLTTG
Group B                     LSIQGGHLGH DNNGGIARGA TPESSGSYGF VRLEGDLLRT EVAGMSLTTG
strain E110019              LSIQGGHLGH DNNGGIARGA TPESSGSYGF VRLEGDLLRT EVAGMSLTTG
strain E22                  LSIQGGHLGH DNNGGIARGA TPESNGSYGF VRLEGDLLRT EVAGMSLTTG
strain H10407               LSIQGGHLGH DNNGGIARGA TPESSGSYGF VRLEGDLLRT EVAGMSLTTG
strain F11 and 536          LSIQGGHLGH VNNGGIARGA TPESSGSYGL VRLEGDLLRT EVAGMSLTTG
strain SECEC                LSIQGGHLGH DNNGGIARGA TPESSGSYGF VRLESDLLRT EVAGMSVTAG
strain H10407               LSIQGGHLGH DNNGGIARGA TPESSGSYGF VRLEGDLLRT EVAGMSVTAG
strain W3110 and DH10B      LSIQGGHLGH DNNGGIARGA TPESSGSYGF VRLEGDLMRT EVAGMSVTAG
strain MG1655               LSIQGGHLGH DNNGGIARGA TPESSGSYGF VRLEGDLMRT EVAGMSVTAG
strain O42                  LSIQGGHLGH DNNGGIARGA TPESSGSYGF VRLEGDLLRT EVAGMSLTTG
strain B7A                  LSIQGGHLGH DNNGGIARGA TPESSGSYGF VRLEGDLLRT EVAGMSVTAG
strain CFT073               LSIQGGHLGH DNNGGIARGA TPESSGSYGF VRLEGDLLRT EVAGMSLTTG
strain O42                  LSIQGGHLGH DNNGGIARGA TPESSGSYGF VRLEGDLLRT EVAGMSLTTG
strain CFT073               LSIQGGHLGH DNNGGIARGA TPESSGSYGF VRLEGDLLRT DVAGMSVTAG
Consensus                   LSIQGGHLGH -NNGGIARGA TPES-GSYG- VRLE-DL-RT -VAGMS-T-G
                            SEQ ID NO: 314 SEQ ID NO: 315
B-Cell Ep.                  ****   ********** ********

801                                                  850
strain E110019              VYGAAGHSSV DVKDDDGSRA GTVRDDAGSL GGYLNLVHTS SGLWADIVAQ
Group A                     VYGAAGHSSV DVKDDDGSRA GTVRDDAGSL GGYLNLVHTS SGLWADIVAQ
strain B171                 VYGAAGHSSV DVKDDDGSRA GTVRDDAGSL GGYLNLVHTS SGLWADIVAQ
strain E22                  VYGAAGHSSV DVKNDDGSRA GTVRDDAGSL GGYLNLVHTS SGLWADIVAQ
strain B171                 VYGAAGHSSV DVKDDDGSRA GTVRDDAGSL GGYLNLTHTS SGLWADIVAQ
strain B171                 VYGAAGHSSV DVKDDDGSRA GTVRDDAGSL GGYLNLTHTS SGLWADIVAQ
strain E24377A and O42      VHGAAGHSSV DVKDDDGSRA GTVRDDAGSL GGYLNLVHTS SGLWADIVAQ
strain E24377A              VYGAAGHSSV DVKDDDGSRA GTARDDAGSL GGYLNLVHTS SGLWADIVAQ
Group B                     VYGAAGHSSV DVKDDDGSRA GTVRDDAGSL GGYLHLVHTS SGLWADIVAQ
strain E110019              VYGAAGHSSV DVKDDDGSRA GTVRDDAGSL GGYLNLVHTS SGLWADIVAQ
strain E22                  VYGAAGHSSV DVKDDDGSRA GTVRDDAGSL GGYLNLVHTS SGLWADIVAQ
strain H10407               VYGAAGHSSV DVKDDDGSRA GTVRDDAGSL GGYLNLTHTS SGLWADIVAQ
strain F11 and 536          VYGAAGHSSV DVKDDDGSRA GTVRDDAGSL GGYLNLVHTS SGLWADIVAQ
strain SECEC                VYSAAGHSSV DVKDDDGSRA GTVRDDAGSL GGYLNLVHTS SGLWADIMAQ
strain H10407               VYGAAGHSSV DVKDDDGSRA GTVRDDAGSL GGYLNLVHTS SGLWADIVAQ
strain W3110 and DH10B      VYGAAGHSSV DVKDDDGSRA GTVRDDAGSL GGYLNLVHTS SGLWADIVAQ
strain MG1655               VYGAAGHSSV DVKDDDGSRA GTVRDDAGCL GGYLNLVHTS SGLWADIVAQ
strain O42                  VYGAAGHSSV DVKDDDGSRA GTVRDDAGSL GGYLNLTHTS SGLWADIVAQ
strain B7A                  VYGAAGHSSV DVKDDDGSRA GTVRDDAGSL GGYLIHNA    SGLWADIVAQ
strain CFT073               VYGAAGHSSV DVKDDDGSRA GTVRDDAGSL GGYMNLHH-- SGLWADIVAQ
strain O42                  VYGAAGHSSV DVKDDDGSRA GTVRDDAGSL GGYMNLTHTS SGLWADIVAQ
strain CFT073               IYGAAGHSSV DVKDDDGSRA GTVRDDAGSL GGYMNLTHTS SGLWADIVAQ
Consensus                   ---AAGHSSV DVK-DDGSRA GT-RDDAG-L GGY--L-H-- SGLWADI-AQ
                               SEQ ID NO: 316
B-Cell Ep.                  ******************* *****

851                                                  900
strain E110019              GTRHSMKASS DNNDFRARGW GWLGSLETGL PFSITDNLML EPQLQYTWQG
Group A                     GTRHSMKASS DNNDFRARGW GWLGSLETGL PFSITDNLML EPQLQYTWQG
strain B171                 GTRHSMKASS DNNDFRARGW GWLGSLETGL PFSITDNLML EPQLQYTWQG
strain E22                  GTHHSMKASS DNNDFRARGW GWLGSLETGL PFSITDNLML EPQLQYTWQG
strain B171                 GTRHSMKASS DNNDFRARGW GWLGSLETGL PFSITDNVML EPQLQYTWQG
strain B171                 GTRHSMKASS DNNDFRARGW GWLGSLETGL PFSITDNLML EPQLQYTWQG
strain E24377A and O42      GTRHSMKASS DNNDFRARGW GWLGSLETGL PFSITDNLML EPQLQYTWQG
strain E24377A              GTRHSMKASS DNNDFRARGW GWLGSLETGL PFSITDNLML EPQLQYTWQG
Group B                     GTRHSMKASS DNNDFRARGW GWLGSLETGL PFSITDNLML EPQLQYTWQG
strain E110019              GTRHSMKASS DNNDFRARGW GWLGSLETGL PFSITDNLML EPQLQYTWQG
strain E22                  GTRHSMKASS DNNDFRARGW GWLGSLETGL PFSITDNLML EPQLQYTWQG
strain H10407               GTRHSMKASS DNNDFRARGW GWLGSLETGL PFSITDNLML EPQLHYTWQG
strain F11 and 536          GTRHSMKASS DNNDFRARGW GWLGSLETGL PFSITDNLML EPQLQYTWQG
strain SECEC                GTRHSMKASS DNNDFRARGW GWLGSLETGL PFSITDNLML EPQLQYTWQG
strain H10407               GTRHSMKAST DNNDFRARGW GWLGSLETGL PFSITDNLML EPQLQYTWQG
strain W3110 and DH10B      GTRHSMKASS DNNDFRARGW GWLGSLETGL PFSITDNLML EPQLQYTWQG
strain MG1655               GTRHSMKASS DNNDFRARGW GWLGSLETGL PFSITDNLML EPQLQYTWQG
strain O42                  GTRHSMKASS DNNDFRARGW GWLGSLETGL PFSITDNLML EPQLHYTWQG
```

```
                          -continued
strain B7A              GTRHSMKASS DNNDFRVRGW GWLGSLETGL PFSITDNLML EPQLQYTWQG
strain CFT073           GTRHSMKASS DNNDFRARGR GWLGSLETGL PFSITDNLML EPRLQYTWQG
strain O42              GTRHSMKASS GNNDFRARGW GWLGSLETGL PFSITDNLML EPRLQYTWQG
strain CFT073           GTRHSMKASS GNNDFRARGR GWLGSLETGL PFSITDNLML EPRLQYTWQG
Consensus               GT-HSMKAS- -NNDFR-RG- GWLGSLETGL PFSITDN-ML EP-L-YTWQG
                                                SEQ ID NO: 317      SEQ ID NO: 318
B-Cell Ep.                                      ********* *******

901                                              950
strain E110019          LSLDDGQDNA GYVKFGHGSA QHVRAGFRLG SHNDMTFGEG TSSRDTLRDS
Group A                 LSLDDGQDNA GYVKFGHGSA QHVRAGFRLG SHNDMTFGEG TSSRDTLRDS
strain B171             LSLDDGQDNA GYVKFGHGSA QHVRAGFRLG SHNDMTFGEG TSSRDTLRDS
strain E22              LSLDDGQDNA GYVKFGHGSA QHVRAGFRLG SHNDMTFGEG TSSRDTLRDS
strain B171             LSLDDGQDNA GYVKFGHGSA QHVRAGFRLG SHNDMSFGEG TSSRDTLRDS
strain E24377A and O42  LSLDDGQDNA GYVKFGHGSA QHVRAGFRLG SHNDMSFGEG TSSRDTLRDS
strain E24377A          LSLDDGQDNA GYVKFGHGSA QHVRAGFRLG SHNDMNFGKG TSSRDTLRDS
Group B                 LSLDDGQDNA GYVKFGHGSA QHVRAGFRLG SHNDMNFGKG TSSRDTLHDS
strain E110019          LSLDDGQDNA GYVKFGHGST QHVRAGFRLG SHNDMTFGEG TSSRDTLRDS
strain E22              LSLDDGQDNA GYVKFGHGSA QHVRAGFRLG SHNDMSFGEG TSSRDTLRDS
strain H10407           LSLDDGQDNA GYVKFGHGSA QHVRAGFRLG SHNDMTFGEG TSSRDTLRDS
strain F11 and 536      LSLDDGQDNA GYVKFGHGSA QHVRAGFRLG SHNDMNFGKG TSSRDTLRDS
strain SECEC            LSLDDGQDNA GYVKFGHGSA QHMRAGFRLG SHNDMTFGEG TSSRDTLRDS
strain H10407           LSLDDGKDNA GYVKFGHGSA QHVRAGFRLG SHNDMTFGEG TSSRAPLRDS
strain W3110 and DH10B  LSLDDGKDNA GYVKFGHGSA QHVRAGFRLG SHNDMTFGEG TSSRAPLRDS
strain MG1655           LSLDDGKDNA GYVKFGHGSA QHVRAGFRLG SHNDMTFGEG TSSRAPLRDS
strain O42              LSLDDGQDNA GYVKFGHGSA QHVRAGFRLG SHNDMTFGEG TSSRDTLRDS
strain B7A              LSLDDGQDNA SYVKFGHGSA QHVRAGFRLG SHHDMNFGKG TSSRDTLRGS
strain CFT073           LSLDDGKDNA GYVKFGHGSA QHVRAGFRLG SHNDMTFGEG TSSRAPLRDS
strain O42              LSLDDGKDNA GYVKFGHGSA QHVRAGFRLG SHNDMTFGEG TSSRAPLRDS
strain CFT073           LSLDDGKDNA GYVKFGHGSA QHVRAGFRLG SHNDMTFGEG TSSRAPLRDS
Consensus               LSLDDG-DNA -YVKFGHGS- QH-RAGFRLG SH-DM-FG-G TSSR--L--S
B-Cell Ep.              ********* **                   ******* **********

951                                             1000
strain E110019          AKHSVSELPV NWWVQPSVIR TFSSRGDMSM GTAAAGSNMT FSPSRNGTSL
Group A                 AKHSVSELPV NWWVQPSVIR TFSSRGDMSM GTAAAGSNMT FSPSRNGTSL
strain B171             AKHSVSELPV NWWVQPSVIR TVSSRGDMSM GTAAAGSNMT FSPSRNGTSL
strain E22              AKHRVRELPV NWWVQPSVIR TVSSRGDMSM GTAAAGSNMT FSPSRNGTSL
strain B171             AKHRVRELPV NWWVQPSVIR TFSSRGDMSM GTAAAGSNMT FSPSRNGTSL
strain B171             AKHRVRELPV NWWVQPSVIR TFSSRGDMSM GTAAAGSNMT FSPSRNGTSL
strain E24377A and O42  AKHRVRELPV NWWVQPSVIR TFSSRGDMSM GTAAAGSNMT FSPSRNGTSL
strain E24377A          AKHSVRELPV NWWVQPSVIR TFSSRGDMSM GTAAAGSNMT FSPSRNGTSL
Group B                 AKHSVRELPV NWWVQPSVIR TFSSRGDMSM GTAAAGSNMT FSPSRNGTSL
strain E110019          AKHRVRELPV NWWVQPSVIR TFSSRGDMSM GTAAAGSNMT FSPSRNGTSL
strain E22              AKHRVRELPV NWWVQPSVIR TFSSRGDMSM GTAAAGSNMT FSPSRNGTSL
strain H10407           TKHGVSELPV NWWVQPSVIR TFSSRGDMSM GTAAAGSNMT FSPSRNGTSL
strain F11 and 536      AKHSVRELPV NWWVQPSVIR TFSSRGDMSM GTAAAGSNMT FSPSQNGTTL
strain SECEC            AKHRVRELPV NWWVQPSVIR TFSSRGDMSM GTAAAGSNMT FSPSQNGTSL
strain H10407           AKHSVRELPV NWWVQPSVIR TFSSRGDMSM GTAAAGSNMT FSPSRNGTSL
strain W3110 and DH10B  AKHSVSELPV NWWVQPSVIR TFSSRGDMRV GTSTAGSGMT FSPSQNGTSL
strain MG1655           AKHSVSELPV NWWVQPSVIR TFSSRGDMRV GTSTAGSGMT FSPSQNGTSL
strain O42              TKHGVSELPV NWWVQPSVIR TFSSRGDMSM GTAAAGSNMT FSPSQNGTSL
strain B7A              AKHSVRELPV NWWVQPSVIR TFSSRGDMSM GTAAAGSNMT FSPSQNGTSL
strain CFT073           AKHSVRELPV NWWVQPSVIR TFSSRGDMRV GTSTAGSGMT FSPSQNGTSL
strain O42              AKHSVRELPV NWWVQPSVIR TFSSRGDMRV GTSTAGSGMT FSPSQNGTSL
strain CFT073           AKHSVRELPV NWWVQPSVIR TFSSRGDMRV GTSTAGSGMT FSPSQNGTSL
Consensus               -KH---ELPV NWWVQPSVIR T-SSRGDM-- GT--AGS-MT FSPS-NGT-L
                                   SEQ ID NO: 319
B-Cell Ep.              ****                          **** ********** **********

1001                                        1044
strain E110019          DLQAGLEARI RENITLGVQA GYAHSVSGSS AEGYNGQATL NMTF
Group A                 DLQAGLEARI RENITLGVQA GYAHSVSGSS AEGYNGQATL NMTF
strain B171             DLQAGLEARV RENITLGVQA GYAHSVSGSS AEGYNGQATL NMTF
strain E22              DLQAGLEARV RENITLGVQA GYAHSVSGSS AEGYNGQATL NVTF
strain B171             DLQAGLEARV RENITLGVQA GYAHSVSGSS AEGYNGQATL NVTF
strain B171             DLQAGLEARV RENITLGVQA GYAHSVSGSS AEGYNGQATL NVTF
strain E24377A and O42  DLQAGLEARV RENITLGVQA GYAHSVSGSS AEGYNGQATL NVTF
strain E24377A          DLQAGLEARV RENITLGVQA GYAHSVSGSS AEGYNGQATL NVTF
Group B                 DLQAGLEARV RENITLGVQA GYAHSVSGSS AEGYNGQATL NVTF
strain E110019          DLQAGLEARV RENITLGVQA GYAHSVSGSS AEGYNGQATL NVTF
strain E22              DLQAGLEARV RENITLGVQA GYAHSVSGSS AEGYNGQATL NVTF
strain H10407           DLQAGLEARV RENITLGVQA GYAHSVSGNS AEGYNGQATL NVTF
strain F11 and 536      DLQAGLEARV RENITLGVQA GYAHSVSGSS AEGYNGQATL NVTF
strain SECEC            DLQAGLEARV RENITLGVQA GYAHSVSGSS AEGYNGQATL NVTF
strain H10407           DLQAGLEARV RENITLGVQA GYAHSVIGSS AEGYNGQATL NVTF
strain W3110 and DH10B  DLQAGLEARV RENITLGVQA GYAHSVSGSS AEGYNGQATL NVTF
strain MG1655           DLQAGLEARV RENITLGVQA GYAHSVSGSS AEGYNGQATL NVTF
strain O42              DLQAGLEARV RENITLGVQA GYAHSVSGSS AEGYNGQATL NVTF
strain B7A              DLQAGLEARV RENITLGVQA GYVHSVSGSS AEGYNGQATL NVTF
```

```
                        -continued
strain CFT073    DLQAGLEARV RENITLGVQA GYAHSINGSS AEGYNSQATL NVTF
strain O42       DLQAGLEARV RENITLGVQA GYAHSVSGSS AEGYNSQATL NVTF
strain CFT073    DLQAGLEARV RENITLGVQA GYAHSVSGSS AEGYNGQATL NVTF
Consensus        DLQAGLEAR- RENITLGVQA GY-HS--G-S AEGYN-QATL N-TF
                 SEQ ID NO: 320 SEQ ID NO: 321
B-Cell Ep.                 ******** *********
SEQ ID NO: 310   SRSHQ(T/S)GV(N/S)GENNS

SEQ ID NO: 311   SRSHQTGVNGENNS

SEQ ID NO: 312   SRSHQSGVSGENNS

SEQ ID NO: 313   SRSHQTGVSGENNS
```

B-Cell Epitopes

| SEQ ID NO | Sequence |
|---|---|
| 322 | RARGKRGG |
| 323 | GETVNGGTLAN |
| 324 | GLEYGPDNEANTGGQWVQDGGTANKTTVTSGGLQRVNPGGSVSDTVISAGGGQSLQGR |
| 325 | WQVVKPGTVATDTVVNTGAEGGPDAENGDTGQFV |
| 326 | AVRTTINKN |
| 327 | RAEGTANT |
| 328 | YAGGDQTVHG |
| 329 | QYVHNGGTASDTVVNS |
| 330 | GGVAGNTTVNQKGRLQVDAGGTATNVTLK |
| 331 | HTATNTRVDDGGTLDVRNGGTATTVSMG |
| 332 | GAAVSGTRSDGKAFSIGG |
| 333 | TLNAGDTATDTTV |
| 334 | GTLAGTTTLN |
| 335 | LTGNGSVEKSGSGTLTV |
| 336 | AIDPTNVTL |
| 337 | TWNIPDNATVQ |
| 338 | SHAGQI |
| 339 | NLNGQNG |
| 340 | DMAQNN |
| 341 | AGNSASGLATSGKG |
| 342 | NGATTEEGAFV |
| 343 | NRDSDESWY |
| 344 | HLGHDNNGGIARGATPESSGSY |
| 345 | YGAAGHSSVDVKDDDGSRAGTVRD |
| 346 | TRHSMKASSDNNDFRA |
| 347 | SLDDGKDNAGY |
| 348 | DMTFGEGTSSRAPLRDSAKHS |
| 349 | DMRVGTSTAGSGMTESPSQNGTSL |
| 350 | YAHSVSGSSAEGYNGQAT |

Orf1767 Protein

NodT-family outer-membrane-factor-lipoprotein efflux transporter protein is referred to herein as 'orf1767.' 'orf1767' protein from *E. coli* NMEC is disclosed in reference 5 (SEQ IDs 3533 & 3534) is also known as: 'orf1488' from *E. coli* NMEC strain IHE3034, 'c1765' from CFT073 and ecp_1346 from 536.

When used according to the present invention, orf1767 protein may take various forms. Preferred orf1767 sequences have 50% or more identity (e.g. 60%, 70%, 80%, 90%, 95%, 96%, 97%, 98%, 99% or more) to SEQ ID NOs 41-47. This includes variants (e.g. allelic variants, homologs, orthologs, paralogs, mutants etc).

Other preferred orf1767 sequences comprise at least n consecutive amino acids from SEQ ID NOs 41-47, wherein n is 7 or more (eg. 8, 10, 12, 14, 16, 18, 20, 25, 30, 35, 40, 50, 60, 70, 80, 90, 100, 150, 200, 250 or more). Preferred fragments comprise an epitope or immunogenic fragment from orf1767. Other preferred fragments lack one or more amino acids (e.g. 1, 2, 3, 4, 5, 6, 7, 8, 9, 10, 15, 20, 25 or more) from the C-terminus and/or the N-terminus of SEQ ID NOs 41-47. Exemplary fragments are the conserved fragments SEQ ID NOs identified in the sequence alignment below.

```
strain UTI89 and IHE3034        (SEQ ID NO: 41)
strain 536 and F11              (SEQ ID NO: 42)
strain SECEC                    (SEQ ID NO: 43)
strain APEC01                   (SEQ ID NO: 44)
strain CFT073                   (SEQ ID NO: 45)
strain E2348-69                 (SEQ ID NO: 46)
Group A: strain Sakai,          (SEQ ID NO: 47)
EDL933, EC508, EC869,
EC4024, EC4042, EC4045,
EC4076, EC4113, EC4115,
EC4196, EC4206, EC4401,
EC4486, EC4501 and TW14588

1                                                                  50
strain UTI89 and IHE3034        MLRRSLIFLV  LLSAGCVSLD  PHYSTPESPI  PATLPGAQGQ  GKAISHDWQQ
strain 536 and F11              MLRRSLIFLV  LLSAGCVSLD  PHYSTPESPI  PATLPGAQGQ  GKAISHDWQQ
strain SECEC                    MLRRSLIFLV  LLSAGCVSLD  PHYSTPESPI  PATLPGAQGQ  GKAISHDWQQ
strain APEC01                   MLRRSLIFLV  LLSAGCVSLD  PHYSTPESPI  PATLPGAQGQ  GKAISHDWQQ
strain CFT073                   MLRRSLIFLV  LLSAGCVSLD  PHYSTPESPI  PATLPGAQGQ  GKAISHDWQQ
strain E2348-69                 MLRRSLIFLV  LLSAGCVSLD  PHYSTPESPI  PATLPGAQGQ  GKAISHDWQQ
Group A                         MLRRSLIFLV  LLSAGCVSLD  PHYSTPESPI  PATLPGAQGQ  GKAISHDWQQ
Consensus                       MLRRSLIFLV  LLSAGCVSLD  PHYSTPESPI  PATLPGAQGQ  GKAISHDWQQ
                                            SEQ ID NO: 351
B-Cell Ep.                      * ********* ********** *****

51                                                                 100
strain UTI89 and IHE3034        VIHDPRLQQV  VTIALNSNRD  VQKAIADIDS  ARALYGQTNA  SLFPTVNAAL
strain 536 and F11              VIHDPRLQQV  VTIALNSNRD  VQKAIADIDS  ARALYGQTNA  SLFPTVNAAL
strain SECEC                    VIHDPRLQQV  VTIALNSNRD  VQKAIADIDS  ARALYGQTNA  SLFPTVNAAL
strain APEC01                   VIHDPRLQQV  VTIALNSNRD  VQKAIADIDS  ARALYGQTNA  SLFPTVNAAL
strain CFT073                   VIHDPRLQQV  VTIALNRNRD  VQKAIADIDS  ARALYGQTNA  SLFPTVNAAL
strain E2348-69                 VIHDPRLQQV  VTIALNSNRD  VQKAIADIDS  ARALYGQTNA  SLFPTVNAAL
Group A                         VIHDPRLQQV  VTIALNSNRD  VQKAIADIDS  ARALYGQTNA  SLFPTVNAAL
Consensus                       VIHDPRLQQV  VTIALN-NRD  VQKAIADIDS  ARALYGQTNA  SLFPTVNAAL
                                                        SEQ ID NO: 352

101                                                                150
strain UTI89 and IHE3034        SSTRSRSLAN  GTGTTAEADG  TVSSYTLDLF  GRNQSLSRAA  RETWLASEFT
strain 536 and F11              SSTRSRSLAN  GTGTTAEADG  TVSSYTLDLF  GRNQSLSRAA  RETWLASEFT
strain SECEC                    SSTRSRSLAN  GTGTTAEADG  TVSSYTLDLF  GRNQSLSRAA  RETWLASEFT
strain APEC01                   SSTRSRSLAN  GTVTTAEADG  TVSSYTLDLF  GRNQSLSRAA  RETWLASEFT
strain CFT073                   SSTRSRSLAN  GTGTTAEADG  TVSSYTLDLF  GRNQSLSRAA  RETWLASEFT
strain E2348-69                 SSTRSRSLAN  GTGTTAEADG  TVSSYTLDLF  GRNQSLSRAA  RETWLASEFT
Group A                         SSTRSRSLAN  GTETTAEADG  TVSSYTLDLF  GRNQSLSRAA  RETWLASEFT
Consensus                       SSTRSRSLAN  GT-TTAEADG  TVSS-TLDLF  GRNQSLSRAA  RETWLASEFT
                                            SEQ ID NO: 353          SEQ ID NO: 354
B-Cell Ep.                      ****** ********** ***

151                                                                200
strain UTI89 and IHE3034        AQNTRLTLIA  EISTAWLTLA  ADNSNLALAK  ETMASAENSL  KIIQRQQQVG
strain 536 and F11              AQNTRLTLIA  EISTAWLTLA  ADNSNLALAK  ETMASAENSL  KIIQRQQQVG
strain SECEC                    AQNTRLTLIA  EISTAWLTLA  ADNSNLALAK  ETMASAENSL  KIIQRQQQVG
strain APEC01                   AQNTRLTLIA  EISTAWLTLA  ADNSNLALAK  ETMASAENSL  KIIQRQQQVG
strain CFT073                   AQNTRLTLIA  EISTAWLTLA  ADNSNLALAK  ETMASAENSL  KIIQRQQQVG
strain E2348-69                 AQSTRLTLIA  EISTAWLTLA  ADNSNLALAK  ETMASAENSL  KIIQRQQQVG
Group A                         AQNTRLTLIA  EISTAWLTLA  ADNSNLALAK  ETMTSAENSL  KIIQRQQQVG
Consensus                       AQ-TRLTLIA  EISTAWLTLA  ADNSNLALAK  ETM-SAENSL  KIIQRQQQVG
                                            SEQ ID NO: 355                      SEQ ID NO: 356
B-Cell Ep.                                                                      ****

201                                                                250
strain UTI89 and IHE3034        TAAATDVSEA  MSVYQQARAS  VASYQTQVMQ  DKNALNLLAG  TTLAENLLPG
strain 536 and F11              TAAATDVSEA  MSVYQQARAS  VASYQTQVMQ  DKNALNLLAG  TTLAENLLPG
strain SECEC                    TAAATDVSEA  MSVYQQARAS  VASYQTQVMQ  DKNALNLLAG  TTLAENLLPG
```

```
                                  -continued
strain APECO1             TAAATDVSEA MSVYQQARAS VASYQTQVMQ DKNALNLLAG TTLAENLLPG
strain CFT073             TAAATDVSEA MSVYQQARAS VASYQTQVMQ DKNALNLLAG TTLAENLLPG
strain E2348-69           TAAATDVSEA MSVYQQARAS VASYQTQVMQ DKNALNLLAG TTLAENLLPG
Group A                   TAAATDVSEA MSVYQQARAS VASYQTQVMQ DKNALNLLAG TTLEENLLPG
Consensus                 TAAATDVSEA MSVYQQARAS VASYQTQVMQ DKNALNLLAG TTL-ENLLPG
B-Cell Ep.                ********* *** ***

251                                                   300
strain UTI89 and IHE3034  TLESLPEQMI SLVPAGVSSD VLLRRPDIQE AEHNLKSANA DIGAARANFF
strain 536 and F11        TLESLPEQMI SLVPAGVSSD VLLRRPDIQE AEHNLKSANA DIGAARANFF
strain SECEC              TLESLPEQMI SLVPAGVSSD VLLRRPDIQE AEHNLKSANA DIGAARANFF
strain APECO1             TLESLPEQMI SLVPAGVSSD VLLRRPDIQE AEHNLKSANA DIGAARANFF
strain CFT073             TLESLPEQMI SLVPAGVSSD VLLRRPDIQE AEHNLKSANA DIGAARANFF
strain E2348-69           TLESLPEQMI SLVPAGVSSD VLLRRPDIQE AEHNLKSANA DIGAARANFF
Group A                   TLESLPEQMI SLVPAGVSSD VLLRRPDIQE AEHNLKSANA DIGAARANFF
Consensus                 TLESLPEQMI SLVPAGVSSD VLLRRPDIQE AEHNLKSANA DIGAARANFF
                                           SEQ ID NO: 357
B-Cell Ep.                                       **** ********** ****

301                                                   350
strain UTI89 and IHE3034  PTISLTASAG VGSDALSSLF SHGMQIWSFA PSVTLPLFTG GSNLAQLRYA
strain 536 and F11        PTISLTASAG VGSDALSSLF SHGMQIWSFA PSVTLPLFTG GSNLAQLRYA
strain SECEC              PTISLTASAG VGSDALSSLF SHGMQIWSFA PSVTLPLFTG GSNLAQLRYA
strain APECO1             PTISLTASAG VGSDALSSLF SHGMQIWSFA PSVTLPLFTG GSNLAQLRYA
strain CFT073             PTISLTASAG VGSDALSSLF SHGMQIWSFA PSVTLPLFTG GSNLAQLRYA
strain E2348-69           PTISLTASAG VGSDALSSLF SHGMQIWSFA PSVTLPLFTG GSNLAQLRYA
Group A                   PTISLTASAG VGSDALSSLF SHGMQIWSFT PSVTLPLFTG GSNLAQLRYA
Consensus                 PTISLTASAG VGSDALSSLF SHGMQIWSF- PSVTLPLFTG GSNLAQLRYA
                                                          SEQ ID NO: 358
B-Cell Ep.                           *** ****

351                                                   400
strain UTI89 and IHE3034  EAQKRGLIAT YEKTVQSAFK DVANALARRT TLEEQLDAQR QYVKAEQQTV
strain 536 and F11        EAQKRGLIAT YEKTVQSAFK DVANALARRT TLEEQLDAQR QYVKAEQQTV
strain SECEC              EAQKRGLIAT YEKTVQSAFK DVANALARRT TLEEQLDAQR QYVKAEQQTV
strain APECO1             EAQKRGLIAT YEKTVQSAFK DVANALARRT TLEEQLDAQR QYVKAEQQTV
strain CFT073             EAQKRGLIAT YEKNVQSAFK DVANALARRT TLEEQLDAQR QYVKAEQQTV
strain E2348-69           EAQKRGLIAT YEKTVQSAFK EVANALARRT TLEEQLDAQS QYVKAEQQTV
Group A                   EAQKRGLIAT YEKTVQRAFK DVANALARRT TLEEQLDAQR QYVKAEQQTV
Consensus                 EAQKRGLIAT YEK-VQ-AFK -VANALARRT TLEEQLDAQ- QYVKAEQQTV
                                               SEQ ID NO: 359 SEQ ID NO: 360
B-Cell Ep.                                                          **********

401                                                   450
strain UTI89 and IHE3034  DVGLRRYQAG VGDYLTVLTA QRSLWSAQQE LLALQLTDFT NRITLWQSLG
strain 536 and F11        DVGLRRYQAG VGDYLTVLTA QRSLWSAQQE LLALQLTDFT NRITLWQSLG
strain SECEC              DVGLRRYQAG VGDYLTVLTA QRSLWSAQQE LLALQLTDFT NRITLWQSLG
strain APECO1             DVGLRRYQAG VGDYLTVLTA QRSLWSAQQE LLALQLTDFT NRITLWQSLG
strain CFT073             DVGLRRYQAG VGDYLTVLTA QRSLWSAQQE LLALQLTDFT NRITLWQSLG
strain E2348-69           DVGLRRYQAG VGDYLTVLTA QRSLWSAQQE LLALQLTDFT NRITLWQSLG
Group A                   DVGLRRYQTG VGDYLTVLTA QRSLWSAQQE LLALQLTDFT NRITLWQSLG
Consensus                 DVGLRRYQ-G VGDYLTVLTA QRSLWSAQQE LLALQLTDFT NRITLWQSLG
                                           SEQ ID NO: 361 strain UTI89 and IHE3034  GGMSSLK
strain 536 and F11        GGMSSLK
strain SECEC              GGMSSLK
strain APECO1             GGMSSLK
strain CFT073             GGMSSLK
strain E2348-69           GGMSSLK
Group A                   GGMSSLK
Consensus                 GGMSSLK B-Cell Epitopes SEQ ID NO: 362            DPHYSTPESPIPATLPGAQGQGKAIS
SEQ ID NO: 363            SRSLANGTGTTAEADGTVS
SEQ ID NO: 364            QQVGTAAATDVSE
SEQ ID NO: 365            RASVAS
SEQ ID NO: 366            DIQEAEHNLKSANADIGA
SEQ ID NO: 367            SAGVGSD
SEQ ID NO: 368            QYVKAEQQTV
```

Orf3515 Protein gspK general secretion pathway protein is referred to herein as 'orf3515.' 'orf3515' protein from *E. coli* NMEC is disclosed in reference 5 (SEQ IDs 7029 & 7030) is also known as: 'orf3332' from *E. coli* NMEC strain IHE3034, 'c3702' from CFT073 and ecp_3039 from 536.

When used according to the present invention, orf3515 protein may take various forms. Preferred orf3515 sequences have 50% or more identity (e.g. 60%, 70%, 80%, 90%, 95%, 96%, 97%, 98%, 99% or more) to SEQ ID NOs 48-60. This includes variants (e.g. allelic variants, homologs, orthologs, paralogs, mutants etc).

Other preferred orf3515 sequences comprise at least n consecutive amino acids from SEQ ID NOs 48-60, wherein n is 7 or more (eg. 8, 10, 12, 14, 16, 18, 20, 25, 30, 35, 40, 50, 60, 70, 80, 90, 100, 150, 200, 250 or more). Preferred fragments comprise an epitope or immunogenic fragment from orf3515. Other preferred fragments lack one or more amino acids (e.g. 1, 2, 3, 4, 5, 6, 7, 8, 9, 10, 15, 20, 25 or more) from the C-terminus and/or the N-terminus of SEQ ID NOs 48-60. Exemplary fragments are the conserved fragments SEQ ID NOs identified in the sequence alignment below.

```
strain 536                  (SEQ ID NO: 48)
strain SECEC                (SEQ ID NO: 49)
strain E22 and B7A          (SEQ ID NO: 50)
strain HS                   (SEQ ID NO: 51)
strain 824377A              (SEQ ID NO: 52)
strain 53638                (SEQ ID NO: 53)
strain H10407               (SEQ ID NO: 54)
strain 82348-69             (SEQ ID NO: 55)
Group A: strain APEC01,     (SEQ ID NO: 56)
UTI89, RS218 and IHE3034
strain E110019              (SEQ ID NO: 57)
strain F11                  (SEQ ID NO: 58)
strain 101-1                (SEQ ID NO: 59)
strain O42                  (SEQ ID NO: 60)

1                                                          50
strain 536                  MITLPPKRGM ALVVVLVLLA VMMLVTITLS GRMQQQLGRT RSQQEYQQAL
strain SECEC                MITLPPKRGM ALVVVLVLLA VMMLVTITLS GRMQQQLGRT RSQQEYQQAL
strain E22 and B7A          MITSPPKRGM ALVVVLVLLA VMMLVTITLS GRMQQQLGRT RSQQEYQQAL
strain HS                   MITSPPKRGM ALVVVLVLLA VMMLVTITLS GRMQQQLGRT RSQQEYQQAL
strain E24377A              MITSPPKRGM ALVVVLVLLA VMMLVTITLS GRMQQQLGRT RSQQEYQQAL
strain 53638                MITSPPKRGM ALVVVLVLLA VMMLVTITLS GRMQQQLGRT RSQQEYQQAL
strain H10407               MITSPPKRGM ALVVVLVLLA VMMLVTITLS GRMQQQLGRT RSQQEYQQAL
strain 62348-69             MITSPPKRGM ALVVVLVLLA VMMLVTITLS SRMQQQLGRT RSQQEYQQAL
Group A                     MITSPPKRGM ALVVVLVLLA VMMLVTITLS GRMQQQLGRT RSQQEYQQAL
strain E110019              MITSPPKRGM ALVVVLVLLA VMMLVTITLS GRMQQQLGRT RSQQEYQQAL
strain F11                  MITSPPKRGM ALVVVLVLLA VIMLVTITLS GRMQQQLGRT RSQQEYQLAL
strain 101-1                MITLPPKRGM ALVVVLVLLA VMMLVTITLS GRMQQQLGRT RSQQEYQQAL
strain O42                  MIISPPKRGM ALAVVLVLLA VMMLVTITLS ARMQQQLGRT RSQQEYQQAL
Consensus                   MI--PPKRGM AL-VVLVLLA V-MLV-ITLS -RMQQQLGRT RSQQEYQ-AL
                                                                 SEQ ID NO: 369
B-Cell Ep.                                                       ***** ******

51                                                         100
strain 536                  WYSASAESLA LSALSLSLKN EKRVHLAQPW ASGPRFFPLP QGQIAVTLRD
strain SECEC                WYSASAESLA LSALSLSLKN EKRVHLAQPW ASGPRFFPLP QGQIAVTLRD
strain E22 and B7A          WYSASAESLA LSALSLSLKN EKRVHLEQPW ASGPRFFPLP QGQIAVTLRD
strain HS                   WYSASAESLA LSALSLSLKN EKRVHLEQPW ASGPRFFPLP QGQIAVTLRD
strain E24377A              WYSASAESLA LSALSLSLKN EKRVHLEQPW ASGPRFFPLP QGQIAVTLRD
strain 53638                WYSASAESLA LSALSLSLKN EKRVHLAQPW TSGPRFFPLP QGQIAVTLRD
strain H10407               WYSASAESLA LSALSLSLKN EKRVHLAQPW ASGPRFFPLP QGQIAVTLRD
strain E2348-69             WYSASAESLA LSALSLSLKN EKRVHLAQPW ASGPRFFPLP QGQIAVTLRD
Group A                     WYSASAESLA LSALSLSLKN EKRVHLAQPW ASGPRFFPLP QGQIAVTLRD
strain E110019              WYSASAESLA LSALSLSLKN EKRVHLTQPW ASGPRFFPLP QGQIAVTLRD
strain F11                  WYSASAESLA LSALSLSLKN EKRVHLAQPW ASGPRFFPLP QGQIAVTLRD
strain 101-1                WYSASAESLA LSALSLSLKN EKRVHLAQPW ASGPRFFPLP QGQIAVTLRD
strain O42                  WYSASAESLA LSALSLSLKN EKRVHLAQPW ASGPRFFPLP QGQIAVTLRD
Consensus                   WYSASAESLA LSALSLSLKN EKRVHL-QPW -SGPRFFPLP QGQIAVTLRD
                                  SEQ ID NO: 370                SEQ ID NO: 371
B-Cell Ep.                                          ** *********

101                                                        150
strain 536                  AQACFNLNAL AQPTTASRPI AVQQLIALIS RLDVPAYRAE LIAESLWEFI
strain SECEC                AQACFNLNAL AQPTTTSRPL AVQQLIALIS RLDVPAYRAE LIAESLWEFI
strain E22 and B7A          AQACFNLNAL AQPTTASRPL AVQQLIALIT RLDVPAYRAE LIAESLWEFI
strain HS                   AQACFNLNAL AQPTTASRPL AVQQLIALIT RLDVPAYRAE LIAESLWEFI
strain E24377A              AQACFNLNAL AQPTTASRPL AVQQLIALIS RLDVPAYRAE LIAESLWEFI
strain 53638                AQACFNLNAL AQPTTASRPL AVQQLIALIS RLDVPAYRAE LIAESLWEFI
strain H10407               AQACFNLNAL AQPTTASRPL AVQQLIALIS RLDVPAYRAE LIAESLWEFI
strain 62348-69             AQACFNLNAL AQPTTASRPL AVQQLIALIS RLDVPAYRAE LIAESLWEFI
Group A                     AQACFNLNAL AQPTTASRPL AVQQLIALIS RLDVPAYRAE LIAESLWEFI
strain E110019              AQACFNLNAL AQPTTASRPL AVQQLIALIS RLDVPAYRAE LIAESLWEFI
strain F11                  AQACFNLNAL AQPTTASRPL AVQQLISLIS RLDVPAYRAE LIAESLWEFI
strain 101-1                AQACFNLNAL AQPTTASRPL AVQQLIALIT RLDVPAYRAE LIAESLWEFI
strain O42                  AQACFNLNAL AQPTTATRPL AVQQLIALIT RLDVPAYRAE LIAESLWEFI
Consensus                   AQACFNLNAL AQPTT--RP- AVQQLI-LI- RL-VPAYRAE LIAESLWEFI
                                                                 SEQ ID NO: 372
```

-continued

B-Cell Ep.                                                  *********

```
                         151                                                                 200
strain 536          DEDRSVQTRL GREDSEYLAR SVPFYAANQP LADISEMRVV QGMDAGLYQK
strain SECEC        DEDRSVQTRL GREDSEYLAR SVPFYAANQP LADISEMRVV QGMDAGLYQK
strain E22 and B7A  DEDRSVQTRL GREDSEYLAR SVPFYAANQP LADISEMRVV QGMDAGLYQK
strain HS           DEDRSVQTRL GREDSEYLAR SVPFYAANQP LADISEMRVV QGMDAGLYQK
strain E24377A      DEDRSVQTRL GREDSEYLAR SVPFYAANQP LADISEMRVV QGMDAGLYQK
strain 53638        DEDRSVQTRL GREDSEYLAR SVPFYAANQP LADISEMRVV QGMDAGLYQK
strain H10407       DEDRSVQTRL GREDSEYLAR SVPFYAANQP LADISEMRVV QGMDAGLYQK
strain E2348-69     DEDRSVQTRL GREDSEYLAR SVPFYAANQP LADISEMRVV QGMDAGLYQK
Group A             DEDRSVQTRL GREDSEYLAR SVPFYAANQP LADISEMRVV QGMDAGLYQK
strain E110019      DEDRSVQTRL GREDSEYLAR SVPFYAANQP LADISEMRVV QGMDDGLYQK
strain F11          DEDRSVQTRL GREDSEYLAR SVPFYAANQP LADISEMRVV QGMDAGLYQK
strain 101-1        DEDRSVQTRL GREDSEYLAR SVPFYAANQP LADISEMRVV QGMDAGLYQK
strain O42          DEDRSIQTRL GREDSEYLAR SVPFYAANQP LADISEMRVV QGMDAGLYQK
Consensus           DEDRS-QTRL GREDSEYLAR SVPFYAANQP LADISEMRVV QGMD-GLYQK
                                    SEQ ID NO: 373
```

B-Cell Ep.                        ***           **

```
                         201                                                                 250
strain 536          LKPLVCALPM ARQQININTL DVTQSVILEA LFDPWLSPVQ ARALLQQRPA
strain SECEC        LKPLVCALPM ARQQININTL DVTQSVILEA LFDPWLSPVQ ARALLQQRPA
strain E22 and B7A  LKPLVCALPM TRQQININTL DVTQSVILEA LFDPWLSPVQ ARALLQQRPA
strain HS           LKPLVCALPM TRQQININTL DVTQSVILEA LFDPWLSPVQ ARALLQQRPA
strain E24377A      LKPLVCALPM TRQQININTL DVTQSVILEA LFDPWLSPVQ ARALLQQRPA
strain 53638        LKPLVCALPM TRQQININTL DVTQSVILEA LFDPWLSPVQ ARALLQQRPA
strain H10407       LKPLVCALPM TRQQININTL DVTQSVILEA LFDPWLSPVQ ARALLQQRPA
strain E2348-69     LKPLVCALPM ARQQININTL DVTQSVILEA LFDPWLSPVQ ARALLQQRPA
Group A             LKPLVCALPM ARQQININTL DVTQSVILEA LFDPWLSPVQ ARALLQQRPA
strain E110019      LKPLVCALPM TRQQININTL DVTQSVLLEA LFDPWLSPVQ ARALLQQRPA
strain F11          LKPLVCALPM ARQQININTL DVTQSVILEA LFDPWLSPVQ ARALLQQRPA
strain 101-1        LKPLVCALPM TRQQININTL DVTQSVILEA LFDPWLSPVQ ARALLQQRPA
strain O42          LKPLVCALPM ARQQININTL DVTQSVILEA LFDPWLSPVQ ARALLQQRPA
Consensus           LKPLVCALPM -RQQININTL DVTQSV-LEA LFDPWLSPVQ ARALLQQRPA
                    SEQ ID NO: 374 SEQ ID NO: 375    SEQ ID NO: 376
```

B-Cell Ep.                                                      ***

```
                         251                                                                 300
strain 536          KGWEDVDQFL AQPLLADVDE RTKKQLKTVL SVDSNYFWLR SDITVNEIEL
strain SECEC        KGWEDVDQFL AQPLLADVDE RTKKQLKTIL SVDSNYFWLR SDITVNEIEL
strain E22 and B7A  KGWEDVDQFL AQPLLADVDE RTKKQLKTVL SVDSNYFWLR SDITVNEIEL
strain HS           KGWEDVDQFL AQPLLADVDE RTKKQLKTVL SVDSNYFWLR SDITVNEIEL
strain E24377A      KGWEDVDQFL AQPLLADVDE RTKKQLKTVL SVDSNYFWLR SDITVNEIEL
strain 53638        KGWEDVDQFL AQPLLADVDE RTKKQLKTVL SVDSNYFWLR SDITVNEIEL
strain H10407       KGWEDVDQFL AQPLLADVDE RTKKQLKTVL SVDSNYFWLR SDITVNEIEL
strain E2348-69     KGWEDVDQFL AQPLLADVDE RTKKQLKTIL SVDSNYFWLR SDITVNEIEL
Group A             KGWEDVDQFL AQPLLADVDE RTKKQLKTIL SVDSNYFWLR SDITVNEIEL
strain E110019      KGWEDVDQFL AQPLLADVDE RTKKQLKTVL SVDSNYFWLR SDITVNEIEL
strain F11          KGWEDVDQFL AQPLLADVDE RTKKQLKTIL SVDSNYFWLR SDITVNEIEL
strain 101-1        KGWEDVDQFL AQPLLADVDE RTKKQLKTVL SVDSNYFWLR SDITVNEIEL
strain O42          KGWEDVDQFL AQPLLADVDD RTKKQLKTVL SVDSNYFWLR SDITVNEIEL
Consensus           KGWEDVDQFL AQPLLADVD- RTKKQLKT-L SVDSNYFWLR SDITVNEIEL
                                                         SEQ ID NO: 377
```

B-Cell Ep.                     ***            ****

```
                         301           325
strain 536          TMNSLIVRMG PQHFSVLWHQ TGESE
strain SECEC        TMNSLIVRMG PQHFSVLWHQ TGESE
strain E22 and B7A  TMNSLIVRMG PQHFSVLWHQ TGESE
strain HS           TMNSLIVRMG PQHFSVLWHQ TGESE
strain E24377A      TMNSLIVRMG PQHFSVLWHQ TGESE
strain 53638        TMNSLIVRMG PQHFSVLWHQ TGESE
strain H10407       TMNSLIVRMG PQHFSVLWHQ TGESE
strain E2348-69     TMNSLIVRMG PQHFSVLWHQ TGESE
Group A             TMNSLIVRMG PQHFSVLWHQ TGESE
strain E110019      TMNSLIVRMG PQHFSVLWHQ TGESE
strain F11          TMNSLIVRMG PQHFSVLWHQ TGESE
strain 101-1        TMNSLIVRMG SQHFSVIWHQ TGESE
strain O42          TMNSLIVRMG PQHFSVLWHQ TGESE
Consensus           TMNSLI-RMG -QHFSV-WHQ TGESE
```

B-Cell Epitopes
---

```
SEQ ID NO: 378      QLGRTRSQQEY
SEQ ID NO: 379      PWASGPRFFPL
SEQ ID NO: 380      AQPTTASRP
SEQ ID NO: 381      RLGREDSEY
SEQ ID NO: 382      YAANQPLA
SEQ ID NO: 383      RPAKGWED
SEQ ID NO: 384      DERTKK
```

Orf3516 protein gspJ general secretion pathway protein is referred to herein as 'orf3516.' 'orf3516' protein from *E. coli* NMEC is disclosed in reference 5 (SEQ IDs 7031 & 7032) is also known as: 'orf3333' from *E. coli* NMEC strain IHE3034 and ecp_3040 from 536.

When used according to the present invention, orf3516 protein may take various forms. Preferred orf3516 sequences have 50% or more identity (e.g. 60%, 70%, 80%, 90%, 95%, 96%, 97%, 98%, 99% or more) to SEQ ID NOs 61-71. This includes variants (e.g. allelic variants, homologs, orthologs, paralogs, mutants etc).

Other preferred orf3516 sequences comprise at least n consecutive amino acids from SEQ ID NOs 61-71, wherein n is 7 or more (eg. 8, 10, 12, 14, 16, 18, 20, 25, 30, 35, 40, 50, 60, 70, 80, 90, 100, 150, 200, 250 or more). Preferred fragments comprise an epitope or immunogenic fragment from orf3516. Other preferred fragments lack one or more amino acids (e.g. 1, 2, 3, 4, 5, 6, 7, 8, 9, 10, 15, 20, 25 or more) from the C-terminus and/or the N-terminus of SEQ ID NOs 61-71. Exemplary fragments are the conserved fragments SEQ ID NOs identified in the sequence alignment below.

```
Group A: strain E22,           (SEQ ID NO: 61)
E24377A and B7A
strain E110019                 (SEQ ID NO: 62)
strain H10407                  (SEQ ID NO: 63)
strain HS and 53638            (SEQ ID NO: 64)
Group B: strain APEC01,        (SEQ ID NO: 65)
UTI89, RS218 and IHE3034
strain F11                     (SEQ ID NO: 66)
strain SECEC                   (SEQ ID NO: 67)
strain 536                     (SEQ ID NO: 68)
strain E2348-69                (SEQ ID NO: 69)
strain 101-1                   (SEQ ID NO: 70)
strain O42                     (SEQ ID NO: 71)

1                                                            50
Group A               MLVAIAIFAS LALMAQQVTN GVTRVNSAVA GHDQKLNLMQ QTMSFLTHDL
strain E110019        MLVAIAIFAS LALMAQQVTN GVTRVNNAVA GHDQKLNLMQ QTMSFLTHDL
strain H10407         MLVAIAIFAS LALMAQQVTN GVTRVNSAVA DHDQKLNLMQ QTMSFLTHDL
strain HS and 53638   MLVAIAIFAS LALMAQQVTN GVTRVNSAVA GHDQKLNLMQ QTMSFLTHDL
Group B               MLVAIAIFAS LALMAQQVTN GVTRVNSAVA GHDQKLNLMQ QTMSFLTHDL
strain F11            MLVAIAIFAS LALMAQQVTN GVTRVNSAVA GHDQKLNLMQ QTMSFLNHDL
strain SECEC          MLVAIAIFAS LALMAQQVTN GVTRVNSAVA GHDQKLNLMQ QTMSFLNHDL
strain 536            MLVAIAIFAS LALMAQQVTN GVTRVNSAVA GHDQKLNLMQ QTMSFLNHDL
strain E2348-69       MLVAIAIFAS LALMAQQVTN GVTRVNSAVA GHDQKLNLMQ QTMSFLNHDL
strain 101-1          MLVAIAIFAL LALMAQQVTN GVTRVNSAVA GHDQKLNLMQ QTMSFLTHDL
strain O42            MLVAIAIFAS LALMAQQVTN GVTRVNSAIG EHDQKLNLMQ QTMSFLTHDL
Consensus             MLVAIAIFA- LALMAQQVTN GVTRVN-A-- -HDQKLNLMQ QTMSFL-HDL
                                 SEQ ID NO: 385           SEQ ID NO: 386
B-Cell Ep.                       ** ****    *** ***

51                                                           100
Group A               TQMMPRPVRG DQGQREPALL AGAGVLASES EGMRFVRGGV VNPLMRLPRS
strain E110019        TQMMPRPVRG EQGQREPALL AGAGVLASES EGMRFVRGGV VNPLMRLPRS
strain H10407         TQMMPRPVRG DQGQREPALL AGAGVLASES EGMRFVRGGV VNPLMRLPRS
strain HS and 53638   TQMMPRPVRG DQGQREPALL AGAGVLASES EGMRFVRGGV VNPLMRMPRS
Group B               TQMMPRPVRG DQGQREPALL AGAGVLVSES GGMRFVRGGV VNPLMRLPRS
strain F11            TQMMPRPVRG DQGQREPALL AGAGVLASES EGMRFVRGGV VNPLMRLPRS
strain SECEC          TQMMPRPVRG DQGQREPALL AGAGVLASES EGMRFVRGGV VNPLMRLPRS
strain 536            TQMMPRPVRG DQGQREPALL AGAGVLASES EGMRFVRGGV VNPLMRLPRS
strain E2348-69       TQMMPRPVRG DQGQREPALL AGAGVLASES EGIRFVRGGV VNPLMRLPRS
strain 101-1          TQMMPRPVRG DQGQREPALL AGAGVLASES GGMRFVRGGV VNLLMRLPRS
strain O42            TQMMPRPVRG DQGQREPALL AGPGVLASES EGMRFVRGGV VNPLMRLPRS
Consensus             TQMMPRPVRG -QGQREPALL AG-GVL-SES -G-RFVRGGV VN-LMR-PRS
                      SEQ ID NO: 387 SEQ ID NO: 388
B-Cell Ep.                   ****** ********

101                                                          150
Group A               NLLTVGYRIH DGYLERLAWP LTDAAGSVKP TMQKLIPADS LRLQFYDGTR
strain E110019        NLLTVGYRIH DGYLERLAWP LTDAAGSVKP TMQKLIPADS LRLQFYDGTR
strain H10407         NLLTVGYRIH DGYLERLAWP LTDAAGSVKP TMQKLIPADS LRLQFYDGTR
strain HS and 53638   NLLTVGYRIH DGYLERLSWP LTDAAGSVKP TMQKLIPADS LHLQFYDGTR
Group B               NLLTVGYRIH DGYLERLAWP LTDAAGSVKP TTQKLIPADS LRLQFYDGTR
strain F11            NLLTVGYRIH GGYLERLAWP LTDAAGSVKP TTQKLIPADS LRLQFHDGTR
strain SECEC          NLLTVGYRIH GGYLERLAWP LTDAAGSVKP TTQKLIPADS LRLQFHDGTR
strain 536            NLLTVGYRIH GGYLERLAWP LTDAAGSVKP TTQKLIPADS LRLQFYDGTR
strain E2348-69       NLLTVGYRIH GGYLERLAWP LTDAAGSVKP TTQKLIPADS LRLQFHDGTC
strain 101-1          NLLTVGYRIH GGYLERLAWP LTDAAGSVKP TTQKLIPADS LRLQFHDGTR
strain O42            NLLTVGYRIH GGYLERLAWP LTDAADSVKP TTQKLIPADS LRLQFYDGTR
Consensus             NLLTVGYRIH -GYLERL-WP LTDAAGSVKP T-QKLIPADS L-LQF-DGT-
                      SEQ ID NO: 389        SEQ ID NO: 390-391
B-Cell Ep.                                   ********* *                        **

151                              189
Group A               WQESWSSVQA IPVAVRMTLH SPQWGEIERI WLLRGPQ~~
strain E110019        WQESWSSVQA IPVAVRMTLH SPQWGEIERI WLLRGPQLS
```

```
strain H10407              WQESWSSVQA IPVAVRMTLH SPQWGEIERI WLLRGPQ~~
strain HS and 53638        WQESWSSVQA IPVAVRMTLH SPQWGEIERI WLLRGPQLS
Group B                    WQESWSSVQA IPVAVRITLH SPQWGEIERI WLLRGPQLS
strain F11                 WQESWSSVQA IPVAVRITLH SPQWGEIERI WLLRGPQLS
strain SECEC               WQESWSSVQA IPVAVRITLH SPQWGEIERI WLLRGPQLS
strain 536                 WQESWSSVQA VPVAVRITLH SPQWGEIERI WLLRGPQLS
strain E2348-69            WQESWSSVQA IPVAVRITLH SPQWGEIERI WLLRGPQLS
strain 101-1               WQESWSSVQA IPVAVRITLH SPQWGEIERI WLLRGPQLS
strain O42                 WQESWSSVQA IPVAVRMTLH SPQWGEIERI WLLRGPQLS
Consensus                  WQESWSSVQA -PVAVR-TLH SPQWGEIERI WLLRGPQ~~
                           SEQ ID NO: 393         SEQ ID NO: 394
B-cell Ep.                 *******

SEQ ID NO: 390             WPLTDAA(G/D)SVKPT
SEQ ID NO: 391             WPLTDAAGSVKPT
SEQ ID NO: 392             WPLTDAADSVKPT

B-Cell Epitopes

SEQ ID NO: 395             TNGVTR
SEQ ID NO: 396             AVAGHD
SEQ ID NO: 397             PRPVRGDQGQREPA
SEQ ID NO: 398             TRWQESWSS
```

Orf3597 Protein tonB-dependent siderophore receptor protein is referred to herein as 'orf3597.' 'orf3597' protein from *E. coli* NMEC is disclosed in reference 5 (SEQ IDs 7193 & 7194) is also known as: 'orf3415' from *E. coli* NMEC strain IHE3034, 'c3775' from CFT073 and ecp_3121 from 536.

When used according to the present invention, orf3597 protein may take various forms. Preferred orf3597 sequences have 50% or more identity (e.g. 60%, 70%, 80%, 90%, 95%, 96%, 97%, 98%, 99% or more) to SEQ ID NOs 72-79. This includes variants (e.g. allelic variants, homologs, orthologs, paralogs, mutants etc).

Other preferred orf3597 sequences comprise at least n consecutive amino acids from SEQ ID NOs 72-79, wherein n is 7 or more (eg. 8, 10, 12, 14, 16, 18, 20, 25, 30, 35, 40, 50, 60, 70, 80, 90, 100, 150, 200, 250 or more). Preferred fragments comprise an epitope or immunogenic fragment from orf3597. Other preferred fragments lack one or more amino acids (e.g. 1, 2, 3, 4, 5, 6, 7, 8, 9, 10, 15, 20, 25 or more) from the C-terminus and/or the N-terminus of SEQ ID NOs 72-79. Exemplary fragments are the conserved fragments SEQ ID NOs identified in the sequence alignment below.

```
strain E2348-69                         (SEQ ID NO: 72)
strain F11                              (SEQ ID NO: 73)
Group A: strain APECO1,UTI89,           (SEQ ID NO: 74)
CFT073, RS218 and IHE3034
strain SECEC                            (SEQ ID NO: 75)
Group B: strain EC508, EC869,           (SEQ ID NO: 76)
EC4024, EC4042, EC4045, EC4076,
EC4113, EC4115, EC4196, EC4206,
EC4401 and EC4486
strain O42                              (SEQ ID NO: 77)
Group C: strain Sakai,                  (SEQ ID NO: 78)
EDL933, EC4501 and
TW14588
strain 536                              (SEQ ID NO: 79)

1                                                  50
strain E2348-69            MAMFTPSFSG LKGRALFSLL FAAPMIHATD SVTTKDGETI TVTADANTAT
strain F11                 MAMFTPSFSG LKGRALFSLL FAAPMIHATD SVTTKDGETI TVTADANTAT
Group A                    MAMFTPSFSG LKGRALFSLL FAAPMIHATD SVTTKDGETI TVTADANTAT
strain SECEC               MAMFTPSFSG LKGRALFSLL FAAPMIHATD SVTTKDGETI TVTADANTAT
Group B                    MAKFTPSFSG IKGRALFSLL FAAPMIHATD TATTKDGETI TVTADANTAT
strain O42                 MAKFTPSFSG IKGRALFSLL FAAPMIHATD TATTKDGETI TVTADANTAT
Group C                    MAKFTPSFSG IKGRALFSLL FAAPMIHATD TATTKDGETI TVTADANTAT
strain 536                 MAKFTPSFSG IKGRALFSLL FAAPMIHATD TATTKDGETI TVTADANTAT
Consensus                  MA-FTPSFSG -KGRALFSLL FAAPMIHATD --TTKDGETI TVTADANTAT
                                      SEQ ID NO: 399         SEQ ID NO: 400
B-Cell Ep.                            ********** **********

51                                                 100
strain E2348-69            EATDGYQPLS TSTATLTDMP MLDIPQVVNT VSDQVLENQN ATTLDEALYN
strain F11                 EATDGYQPLS TSTATLTDMP MLDIPQVVNT VSDQVLENQN ATTLDEALYN
Group A                    EATDGYQPLS TSTATLTDMP MLDIPQVVNT VSDQVLENQN ATTLDEALYN
strain SECEC               EATDGYQPLS TSTATLTDMP MLDIPQVVNT VSDQVLENQN ATTLDEALYN
Group B                    EATDGYQPLS TSTATLTDMP MLDIPQVVNT VSDQVLENQN ATTLDEALYN
strain O42                 EATDGYQPLS TSTATLTDMP MLDIPQVVNT VSDQVLENQN ATTLDEALYN
Group C                    EATDGYQPLS TSTATLTDMP MLDIPQVVNT VSDQVLENQN ATTLDEALYN
strain 536                 EATDGYQPLS TSTATLTDMP MLDIPQVVNT VSDQVLENQN ATTLDEALYN
Consensus                  EATDGYQPLS TSTATLTDMP MLDIPQVVNT VSDQVLENQN ATTLDEALYN
B-Cell Ep.                 ********** ******                        ****** ****
```

-continued

```
                          101                                           150
strain E2348-69   VSNVVQTNTL GGTQDAFVRR GFGANRDGSI MTNGLRTVLP RSFNAATERV
strain F11        VSNVVQTNTL GGTQDAFVRR GFGANRDGSI MTNGLRTVLP RSFNAATERV
Group A           VSNVVQTNTL GGTQDAFVRR GFGANRDGSI MTNGLRTVLP RSFNAATERV
strain SECEC      VSNVVQTNTL GGTQDAFVRR GFGANRDGSI MTNGLRTVLP RSFNAATERV
Group B           VSNVVQTNTL GGTQDAFVRR GFGANRDGSI MTNGLRTVLP RSFNAATERV
strain O42        VSNVVQTNTL GGTQDAFVRR GFGANRDGSI MTNGLRTVLP RSFNAATERV
Group C           VSNVVQTNTL GGTQDAFVRR GFGANRDGSI MTNGLRTVLP RSFNAATERV
strain 536        VSNVVQTNTL GGTQDAFVRR GFGANRDGSI MTNGLRTVLP RSFNAATERV
Consensus         VSNVVQTNTL GGTQDAFVRR GFGANRDGSI MTNGLRTVLP RSFNAATERV
B-Cell Ep.        ***  ******            ********

151                                           200
strain E2348-69   EVLKGPASTL YGILDPGGLI NVVTKRPEKT FHGSVSATSS SFGGGTGQLD
strain F11        EVLKGPASTL YGILDPGGLI NVVTKRPEKT FHGSVSATSS SFGGGTGQLD
Group A           EVLKGPASTL YGILDPGGLI NVVTKRPEKT FHGSVSATSS SFGGGTGQLD
strain SECEC      EVLKGPASTL YGILDPGGLI NVVTKRPEKT FHGSVSATSS SFGGGTGQLD
Group B           EVLKGPASTL YGILDPGGLI NVVTKRPEKT FHGSVSATSS SFGGGTGQLD
strain O42        EVLKGPASTL YGILDPGGLI NVVTKRPEKT FHGSVSATSS SFGGGTGQLD
Group C           EVLKGPASTL YGILDPGGLI NVVTKRPEKT FHGSVSATSS SFGGGTGQLD
strain 536        EVLKGPASTL YGILDPGGLI NVVTKRPEKT FHGSVSATSS SFGGGTGQLD
Consensus         EVLKGPASTL YGILDPGGLI NVVTKRPEKT FHGSVSATSS SFGGGTGQLD
B-Cell Ep.                             ******  ********** **********

201                                           250
strain E2348-69   ITGPIEGTQL AYRLTGEVQD EDYWRNFGKE RSTFIAPSLT WFGDNATVTM
strain F11        ITGPIEGTQL AYRLTGEVQD EDYWRNFGKE RSTFIAPSLT WFGDNATVTM
Group A           ITGPIEGTQL AYRLTGEVQD EDYWRNFGKE RSTFIAPSLT WFGDNATVTM
strain SECEC      ITGPIEGTQL AYRLTGEVQD EDYWRNFGKE RSTFIAPSLT WFGDNATVTM
Group B           ITGPIEGTQL AYRLTGEVQD EDYWRNFGKE RSTFIAPSLT WFGDNATVTM
strain O42        ITGPIEGTQL AYRLTGEVQD EDYWRNFGKE RSTFIAPSLT WFGDNATVTM
Group C           ITGPIEGTQL AYRLTGEVQD EDYWRNFGKE RSTFIAPSLT WFGDNATVTM
strain 536        ITGPIEGTQL AYRLTGEVQD EDYWRNFGKE RSTFIAPSLT WFGDNATVTM
Consensus         ITGPIEGTQL AYRLTGEVQD EDYWRNFGKE RSTFIAPSLT WFGDNATVTM
B-Cell Ep.        *******               *****  ******

251                                           300
strain E2348-69   LYSHRDYKTP FDRGTIFDLT TKQPVNVDRK IRFDEPFNIT DGQSDLAQLN
strain F11        LYSHRDYKTP FDRGTIFDLT TKQPVNVDRK IRFDEPFNIT DGQSDLAQLN
Group A           LYSHRDYKTP FDRGTIFDLT TKQPVNVDRK IRFDEPFNIT DGQSDLAQLN
strain SECEC      LYSHRDYKTP FDRGTIFDLT TKQPVNVDRK IRFDEPFNIT DGQSDLAQLN
Group B           LYSHRDYKTP FDRGTIFDLT TKQPVNVDRK IRFDEPFNIT DGQSDLAQLN
strain O42        LYSHRDYKTP FDRGTIFDLT TKQPVNVDRK IRFDEPFNIT DGQSDLAQLN
Group C           LYSHRDYKTP FDRGTIFDLT TKQPVNVDRK IRFDEPFNIT DGQSDLAQLN
strain 536        LYSHRDYKTP FDRGTIFDLT TKQPVNVDRK IRFDEPFNIT DGQSDLAQLN
Consensus         LYSHRDYKTP FDRGTIFDLT TKQPVNVDRK IRFDEPFNIT DG-SDLAQLN
B-Cell Ep.        ***** **              ******              **** ******

301                                           350
strain E2348-69   AEYHLNSQWT ARFDYSYSQD KYSDNQARVT AYDATTGTLT RRVDATQGST
strain F11        AEYHLNSQWT ARFDYSYSQD KYSDNQARVT AYDATTGTLT RRVDATQGST
Group A           AEYHLNSQWT ARFDYSYSQD KYSDNQARVT AYDATTGTLT RRVDATQGST
strain SECEC      AEYHLNSQWT ARFDYSYSQD KYSDNQARVT AYDATTGTLT RRVDATQGST
Group B           AEYHLNSQWT ARFDYSYSQD KYSDNQARVT AYDATTGTLT RRVDATQGST
strain O42        AEYHLNSQWT ARFDYSYSQD KYSDNQARVT AYDATTGTLT RRVDATQGST
Group C           AEYHLNSQWT ARFDYSYSQD KYSDNQARVT AYDATTGTLT RRVDATQGST
strain 536        AEYHLNSQWT ARFDYSYSQD KYSDNQARVT AYDATTGTLT RRVDATQGST
Consensus         AEYHLNSQWT ARFDYSYSQD KYSDNQARVT AYDATTGTLT RRVDATQGST
                         SEQ ID NO: 401
B-Cell Ep.             ***** ********** **********   ********

351                                           400
strain E2348-69   QRMHATRADL QGNVDIAGFY NEILGGVSYE YYDLLRTDMI RCKKAKDFNI
strain F11        QRMHATRADL QGNVDIAGFY NEILGGVSYE YYDLLRTDMI RCKKAKDFNI
Group A           QRMHATRADL QGNVDIAGFY NEILGGVSYE YYDLLRTDMI RCKKAKDFNI
strain SECEC      QRMHATRADL QGNVDIAGFY NEILGGVSYE YYDLLRTDMI RCKKAKDFNI
Group B           QRMHSTRADL QGNVDIAGFY NEILGGVSYE YYDLLRTDMI RCENAKDENI
strain O42        QRMHATRADL QGNVDIAGFY NEILGGVSYE YYDLLRTDMI RCENAKDFNI
Group C           QRMHSTRADL QGNVDIAGFY NEILGGVSYE YYDLLRTDMI RCENAKDFNI
strain 536        QRMHATRADL QGNVDIAGFY NEILGGVSYE YYDLLRTDMI RCKKAKDFNI
Consensus         QRMH-TRADL QGNVDIAGFY NEILGGVSYE YYDLLRTDMI RCK-AKDFNI
                         SEQ ID NO: 402
B-Cell. Ep.       ***

401                                           450
strain 52348-69   YNPVYGNTSK CTTVSASDSD QTIKQESYSA YAQDALYLTD NWIAVAGIRY
strain F11        YNPVYGNTSK CTTVSASDSD QTIKQESYSA YAQDALYLTD NWIAVAGIRY
Group A           YNPVYGNTSK CTTVSASDSD QTIKQENYSA YAQDALYLTD NWIAVAGIRY
strain SECEC      YNPVYGNTSK CTTVSASDSD QTIKQESYSA YAQDALYLTD NWIAVAGIRY
Group B           YNPVYGNTSK CTTVSASDSD QTIKQESYSA YAQDALYLTD NWIAVAGIRY
strain O42        YNPVYGNTSK CTTVSASDSD QTIKQESYSA YAQDALYLTD NWIAVAGIRY
```

```
                            -continued
Group C          YNPVYGNTSK CTTVSASDSD QTIKQESYSA YAQDALYLTD NWIAVAGIRY
strain 536       YNPVYGNTSK CTTVSASDSD QTIKQESYSA YAQDALYLTD NWIAVAGIRY
Consensus        YNPVYGNTSK CTTVSASDSD QTIKQE-YSA YAQDALYLTD NWIAVAGIRY
                  SEQ ID NO: 403              SEQ ID NO: 404
B-Cell Ep.       ******** ********** ********** *

451                                              500
strain E2348-69  QYYTQYAGKG RPFNVNTDSR DEQWTPKLGL VYKLTPSVSL FANYSQTFMP
strain F11       QYYTQYAGKG RPFNVNTDSR DEQWTPKLGL VYKLTPSVSL FANYSQTFMP
Group A          QYYTQYAGKG RPFNVNTDSR DEQWTPKLGL VYKLTPSVSL FANYSQTFMP
strain SECEC     QYYTQYAGKG RPFNVNTDSR DEQWTPKLGL VYKLTPSVSL FANYSQTFMP
Group B          QYYTQYAGKG RPFNVNTDSR DEQWTPKLGL VYKLTPSVSL FANYSQTFMP
strain O42       QYYTQYAGKG RPFNVNTDSR DEQWTPKLGL VYKLTPSVSL FANYSQTFMP
Group C          QYYTQYAGKG RPFNVNTDSR DEQWTPKLGL VYKLTPSVSL FANYSQTFMP
strain 536       QYYTQYAGKG RPFNVNTDSR DEQWTPKLGL VYKLTPSVSL FANYSQTFMP
Consensus        QYYTQYAGKG RPFNVNTDSR DEQWTPKLGL VYKLTPSVSL FANYSQTFMP
B-Cell Ep.       ****** ********** *****

501                                              550
strain E2348-69  QSSIASYIGD LPPESSNAYE VGAKFELFDG ITADIALFDI HKRNVLYTES
strain F11       QSSIASYIGD LPPESSNAYE VGAKFELFDG ITADIALFDI HKRNVLYTES
Group A          QSSIASYIGD LPPESSNAYE VGAKFELFDG ITADIALFDI HKRNVLYTES
strain SECEC     QSSIASYIGD LPPESSNAYE VGAKFELFDG ITADIALFDI HKRNVLYTES
Group B          QSSIASYIGD LPPESSNAYE VGAKFELFDG ITADIALFDI HKRNVLYTES
strain O42       QSSIASYIGD LPPESSNAYE VGAKFELFDG ITADIALFDI HKRNVLYTES
Group C          QSSIASYIGD LPPESSNAYE VGAKFELFDG ITADIALFDI HKRNVLYTES
strain 536       QSSIASYIGD LPPESSNAYE VGAKFELFDG ITADIALFDI HKRNVLYTES
Consensus        QSSIASYIGD LPPESSNAYE VGAKFELFDG ITADIALFDI HKRNVLYTES
B-Cell Ep.       ** **********                                     *

551                                              600
strain 52348-69  VGDETIAKTA GRVRSRGVEV DLAGALTENI NIIASYGYTD AKVLEDPDYA
strain F11       VGDETIAKTA GRVRSRGVEV DLAGALTENI NIIASYGYTD AKVLEDPDYA
Group A          IGDETIAKTA GRVRSRGVEV DLAGALTENI NIIASYGYTD AKVLEDPDYA
strain SECEC     VGDETIAKTA GRVRSRGVEV DLAGALTENI NIIASYGYTD AKVLEDPDYA
Group B          IGDETIAKTA GRVRSRGVEV DLAGALTENI NIIASYGYTD AKVLEDPDYA
strain O42       IGDETIAKTA GRVRSRGVEV DLAGALTENI NIIASYGYTD AKVLEDPDYA
Group C          IGDETIAKTA GRVRSRGVEV DLAGALTENI NIIASYGYTD AKVLEDPDYA
strain 536       VGDETIAKTA GRVRSRGVEV DLAGALTENI NIIASYGYTD AKVLEDPDYA
Consensus        -GDETIAKTA GRVRSRGVEV DLAGALTENI NIIASYGYTD AKVLEDPDYA
                  SEQ ID NO: 405
B-Cell Ep.       *********                                 **********

601                                              650
strain E2348-69  GKPLPNVPRH TGSLFLTYDI HNMPGNNTLT FGGGGHGVSR RSATNGADYY
strain F11       GKPLPNIPRH TGSLFLTYDI HNMPGNNTLT FGGGGHGVSR RSATNGADYY
Group A          GKPLPNVPRH TGSLFLTYDI HNMPGNNTLT FGGGGHGVSR RSATNGADYY
strain SECEC     GKPLPNVPRH TGSLFLTYDI HNMPGNNTLT FGGGGHGVSR RSATNGADYY
Group B          GKPLPNVPRH TGSLFLTYDI HNMPGNNTLT FGGGGHGVSR RSATNGADYY
strain O42       GKPLPNVPRH TGSLFLTYDI HNMPGNNTLT FGGGGHGVSR RSATNGADYY
Group C          GKPLPNVPRH TGSLFLTYDI HNMPGNNTLT FGGGGHCVSR RSATNGADYY
strain 536       GKPLPNVPRH TGSLFLTYDI HNMPGNNTLT FGGGGHGVSR RSATNGADYY
Consensus        GKPLPN-PRH TGSLFLTYDI HNMPGNNTLT FGGGGH-VSR RSATNGADYY
                                                   SEQ ID NO: 406         SEQ ID NO: 407
B-Cell Ep.       **********             ********* ********** **********

651                                              700
strain E2348-69  LPGYFVADAF AAYKMKLQYP VTLQLNVKNL FDKTYYTSSI ATNNLGNQIG
strain F11       LPGYFVADAF AAYKMKLQYP VTLQLNVKNL FDKTYYTSSI ATNNLGNQIG
Group A          LPGYFVADAF AAYKMKLQYP VTLQLNVKNL FDKTYYTSSI ATNNLGNQIG
strain SECEC     LPGYFVADAF AAYKMKLQYP VTLQLNVKNL FDKTYYTSSI ATNNLGNQIG
Group B          LPGYFVADAF AAYKMKLQYP VTLQLNVKNL FDKTYYTSSI ATNNLGNQIG
strain O42       LPGYFVADAF AAYKMKLQYP VTLQLNVKNL FDKTYYTSSI ATNNLGNQIG
Group C          LPGYFVADAF AAYKMKLQYP VTLQLNVKNL FDKTYYTSSI ATNNLGNQIG
strain 536       LPGYFVADAF AAYKMKLQYP VTLQLNVKNL FDKTYYTSSI ATNNLGNQIG
Consensus        LPGYFVADAF AAYKMKLQYP VTLQLNVKNL FDKTYYTSSI ATNNLGNQIG
B-Cell Ep.                                                * **********

701        713
strain E2348-69  DPREVQFTVK MEF
strain F11       DPREVQFTVK MEF
Group A          DPREVQFTVK MEF
strain SECEC     DPREVQFTVK MEF
Group B          DPREVQFTVK MEE
strain O42       DPREVQFTVK MEE
Group C          DPREVQFTVK MEF
strain 536       DPREVQFTVK MEF
Consensus        DPREVQFTVK MEF
B-Cell Ep.       *****
```

B-Cell Epitopes

```
SEQ ID NO: 408        SVTTKDGETITVTADANTATEATDGYQPLSTSTATL
SEQ ID NO: 409        VLENQNATTL
SEQ ID NO: 410        NTLGGTQDA
SEQ ID NO: 411        GANRDGSI
SEQ ID NO: 412        KRPEKTFHGSVSATSSSFGGGTGQLDITGPIEG
SEQ ID NO: 413        GEVQDEDYWRN
SEQ ID NO: 414        DYKTPFD
SEQ ID NO: 415        KQPVNV
SEQ ID NO: 416        FNITDGQSDL
SEQ ID NO: 417        SYSQDKYSDNQARVTAYDATTGTLT
SEQ ID NO: 418        VDATQGSTQRM
SEQ ID NO: 419        PVYGNTSKCTTVSASDSDQTIKQESYSAY
SEQ ID NO: 420        QYAGKGRPFNVNTDSRDEQWT
SEQ ID NO: 421        GDLPPESSNAYE
SEQ ID NO: 422        SVGDETIAKT
SEQ ID NO: 423        AKVLEDRDYAGKPLPNVPRH
SEQ ID NO: 424        NMPGNNTLTEGGGHGVSRRSATNGADYY
SEQ ID NO: 425        IATNNLGNQIGDPREV
```

Orf3613 Protein

Fimbrial protein is referred to herein as 'orf3613.' 'orf3613' protein from E. coli NMEC is disclosed in reference 5 (SEQ IDs 7225 & 7226) is also known as: 'orf3431' from E. coli NMEC strain IHE3034 and 'c3791' from CFT073.

When used according to the present invention, orf3613 protein may take various forms. Preferred orf3613 sequences have 50% or more identity (e.g. 60%, 70%, 80%, 90%, 95%, 96%, 97%, 98%, 99% or more) to SEQ ID NOs 80-81. This includes variants (e.g. allelic variants, homologs, orthologs, paralogs, mutants etc).

Other preferred orf3613 sequences comprise at least n consecutive amino acids from SEQ ID NOs 80-81, wherein n is 7 or more (eg. 8, 10, 12, 14, 16, 18, 20, 25, 30, 35, 40, 50, 60, 70, 80, 90, 100, 150, 200, 250 or more). Preferred fragments comprise an epitope or immunogenic fragment from orf3613. Other preferred fragments lack one or more amino acids (e.g. 1, 2, 3, 4, 5, 6, 7, 8, 9, 10, 15, 20, 25 or more) from the C-terminus and/or the N-terminus of SEQ ID NOs 80-81. Exemplary fragments are the conserved fragments SEQ ID NOs identified in the sequence alignment below.

```
Group A: strain UTI89, CFT073,     (SEQ ID NO: 80)
APECO1, RS218 and IHE3034
Strain O42                         (SEQ ID NO: 81)

1                                                  50
Group A         MLKKTLLSMF ATALLSGVAF NALADDANQG SGKITFKGEV IDAPCSIAPG
strain O42      MFKKTLLSMF ATALLSGVAF NALADDANQG SGKITFKGEV IDAPCSIAPG
Consensus       M-KKTLLSMF ATALLSGVAF NALADDANQG SGKITFKGEV IDAPCSIAPG
                         SEQ ID NO: 426
B-Cell Ep.                          ****** *****           ******

51                                                 100
Group A         DEDQTINLGE VADTVLKSGQ KSLPVDVTIH LQDCILSDGT NTVDKVKITF
strain O42      DEDQTINLGE VADTVLKSGQ KSLPVDVTIH LQDCILSDGT NTVDKVKITF
Consensus       DEDQTINLGE VADTVLKSGQ KSLPVDVTIH LQDCILSDGT NTVDKVKITF
B-Cell Ep.      *******

101                                                150
Group A         SSASVDATDS NLLKNTLEGN IGGATDVGVR LVKSDNTNVT LGTPITINFP
strain O42      SSASVDATDS NLLKNTLEGN IGGATDVGVR LVKSDNTNVT LGTPITINFP
Consensus       SSASVDATDS NLLKNTLEGN IGGATDVGVR LVKSDNTNVT LGTPITINFP
B-Cell Ep.      *******    *** ******                                  ***

151                            187
Group A         TTNSYQELNF KARMESLGRT ATPGNVQAQA NYVLDYK
strain O42      TTNSYQELNF KARMESLGRT ATPGNVQAQA NYVLDYK
Consensus       TTNSYQELNF KARMESLGRT ATPGNVQAQA NYVLDYK
B-Cell Ep.      *****           **** *********
```

B-Cell Epitopes

```
SEQ ID NO: 427        ADDANQGSGKIT
SEQ ID NO: 428        CSIAPGDEDQTIN
SEQ ID NO: 429        ASVDATDS
SEQ ID NO: 430        EGNIGGATD
SEQ ID NO: 431        NFPTTNSY
SEQ ID NO: 432        LGRTATPGNVQAQ
```

Recp3768 Protein

Hemolysin A protein is referred to herein as 'recp3768.' 'recp3768' protein from *E. coli* UPEC is disclosed in reference WO2008/020330 (SEQ IDs 3) is also known as: 'c3570' from CFT073 and ecp_3827 from 536.

When used according to the present invention, recp3768 protein may take various forms. Preferred recp3768 sequences have 50% or more identity (e.g. 60%, 70%, 80%, 90%, 95%, 96%, 97%, 98%, 99% or more) to SEQ ID NOs 101-105. This includes variants (e.g. allelic variants, homologs, orthologs, paralogs, mutants etc).

Other preferred recp3768 sequences comprise at least n consecutive amino acids from SEQ ID NOs 101-105, wherein n is 7 or more (eg 8, 10, 12, 14, 16, 18, 20, 25, 30, 35, 40, 50, 60, 70, 80, 90, 100, 150, 200, 250 or more). Preferred fragments comprise an epitope or immunogenic fragment from recp3768. Other preferred fragments lack one or more amino acids (e.g. 1, 2, 3, 4, 5, 6, 7, 8, 9, 10, 15, 20, 25 or more) from the C-terminus and/or the N-terminus of SEQ ID NOs 101-105. Exemplary fragments are the conserved fragments SEQ ID NOs identified in the sequence alignment below.

```
Strain 536              (SEQ ID NO: 101)
Strain 536              (SEQ ID NO: 102)
Strain CFT073           (SEQ ID NO: 103)
Group A: strain RS218,  (SEQ ID NO: 104)
UTI89 and F11
Strain E110019          (SEQ ID NO: 105)

1                                                        50
strain 536              MPTITTAQIK STLQSAKQSA ANKLHSAGQS TKDALKKAAE QTRNAGNRLI
strain 536              MPTITTAQIK STLQSAKQSA ANKLHSAGQS TKDALKKAAE QTRNAGNRLI
strain CFT073           MPTITTAQIK STLQSAKQSS ANKLHSAGQS TKDALKKAAE QTRNAGNRLI
Group A                 MPTITTAQIK STLQSAKQSA ANKLHSAGQS TKDALKKAAE QTRNAGNRLI
strain E110019          MPTITTAQIK STLQSAKQSA ENKLHSAGQS TKDALKKAAE KTRNAGNRLI
Consensus               MPTITTAQIK STLQSAKQS- -NKLHSAGQS TKDALKKAAE -TRNAGNRLI
                          SEQ ID NO: 433        SEQ ID NO: 434
B-Cell Ep.                                 ****** ********** ********** *****

51                                                       100
strain 536              LLIPKDYKGQ GSSLNDLVRT ADELGIEVQY DEKNGTAITK QVFGTAEKLI
strain 536              LLIPKDYKGQ GSSLNDLVRT ADELGIEVQY DEKNGTAITK QVFGTAEKLI
strain CFT073           LLIPKDYKGQ GSSLNDLVRT ADELGIEVQY DEKNGTAITK QVFGTAEKLI
Group A                 LLIPKDYKGQ GSSLNDLVRT ADELGIEVQY DEKNGTAITK QVFGTAEKLI
strain E110019          LLIPKDYKGQ GSSLNDLVRT ADELGIEVQY DEKNGTAITK QVFGTAEKLI
Consensus               LLIPKDYKGQ GSSLNDLVRT ADELGIEVQY DEKNGTAITK QVFGTAEKLI
                                        SEQ ID NO: 435
B-Cell Ep.              ***** ***                          ** ********

101                                                      150
strain 536              GLTERGVTIF APQLDKLLQK YQKAGNKLGG SAENIGDNLG KAGSVLSTFQ
strain 536              GLTERGVTIF APQLDKLLQK YQKAGNKLGG SAENIGDNLG KAGSVLSTFQ
strain CFT073           GLTERGVTIF APQLDKLLQK YQKAGNKLGG SAENIGDNLG KAGSVLSTFQ
Group A                 GLTERGVTIF APQLDKLLQK YQKAGNKLGG SAENIGDNLG KAGSVLSTFQ
strain E110019          GLTERGVTIF APKLDKLLQK YQKAGNKLGG SAENIGDNLG KAGGILSTFQ
Consensus               GLTERGVTIF AP-LDKLLQK YQKAGNKLGG SAENIGDNLG KAG--LSTFQ
                                               SEQ ID NO: 436
B-Cell Ep.                          ********* ********** *

151                                                      200
strain 536              NFLGTALSSM KIDELIKKQK SGSNVSSSEL AKASIELINQ LVDTAASINN
strain 536              NFLGTALSSM KIDELIKKQK SGGNVSSSEL AKASIELINQ LVDTAASLNN
strain CFT073           NFLGTALSSM KIDELIKRQK SGSNVSSSEL AKASIELINQ LVDTAASINN
Group A                 NFLGTALSSM KIDELIKKQK SGSNVSSSEL AKASIELINQ LVDTAASINN
strain E110019          NFLGTALSSM KIDELIKKQK SGGNVSSSEM AEASIELINQ LVDTAASLNN
Consensus               NFLGTALSSM KIDELIK-QK SG-NVSSSE- A-ASIELINQ LVDTAAS-NN
                              SEQ ID NO: 437                    SEQ ID NO: 438
B-Cell Ep.                                ***** **********

201                                                      250
strain 536              NVNSFSQQLN KLGSVLSNTK HLNGVGNKLQ NLPNLDNIGA GLDTVSGILS
strain 536              NVNSFSQQLN KLGSVLSNTK HLNGVGNKLQ NLPNLDNIGA GLDTVSGILS
strain CFT073           NVNSFSQQLN KLGSVLSNTK HLTGVGNKLQ NLPNLDNIGA GLDTVSGILS
Group A                 NVNSFSQQLN KLGSVLSNTK HLNGVGNKLQ NLPNLDNIGA GLDTVSGILS
strain E110019          NVNSFSQQLN TLGSVLSNTK HLNGVGNKLQ NLPNLDNIGA GLDTVSGILS
Consensus               NVNSFSQQLN -LGSVLSNTK HL-GVGNKLQ NLPNLDNIGA GLDTVSGILS
                        SEQ ID NO: 439 SEQ ID NO: 440    SEQ ID NO: 441

251                                                      300
strain 536              VISASFILSN ADADTGTKAA AGVELTTKVL GNVGKGISQY IIAQRAAQGL
strain 536              AISASFILSN ADADTGTKAA AGVELTTKVL GNVGKGISQY IIAQRAAQGL
strain CFT073           AISASFILSN ADADTGTKAA AGVELTTKVL GNVGKGISQY IIAQRAAQGL
Group A                 AISASFILSN ADADTGTKAA AGVELTTKVL GNVGKGISQY IIAQRAAQGL
strain E110019          TISASFILSN ADADTRTKAA AGVELTTKVL GNVGKGISQY IIAQRAAQGL
Consensus               -ISASFILSN ADADT-TKAA AGVELTTKVL GNVGKGISQY IIAQRAAQGL
                              SEQ ID NO: 442         SEQ ID NO: 443
```

-continued

```
B-Cell Ep.            **********  **                         ****

301                                                350
strain 536            STSAAAAGLI  ASAVTLAISP  LSFLSIADKF  KRANKIEEYS  QRFKKLGYDG
strain 536            STSAAAAGLI  ASVVTLAISP  LSFLSIADKF  KRANKIEEYS  QRFKKLGYDG
strain CFT073         STSAAAAGLI  ASVVTLAISP  LSFLSIADKF  KRANKIEEYS  QRFKKLGYDG
Group A               STSAAAAGLI  ASVVTLAISP  LSFLSIADKF  KRANKIEEYS  QRFKKLGYDG
strain E110019        STSAAAAGLI  ASAVILAISP  LSFLSIADKF  KRANKIEEYS  QRFKKLGYDG
Consensus             STSAAAAGLI  AS-V-LAISP  LSFLSIADKF  KRANKIEEYS  QRFKKLGYDG
                                             SEQ ID NO: 444
B-Cell Ep.            *****

351                                                400
strain 536            DSLLAAFHKE  TGAIDASLTT  ISTVLASVSS  GISAAATTSL  VGAPVSALVG
strain 536            DSLLAAFHKE  TGAIDASLTT  ISTVLASVSS  GISAAATTSL  VGAPVSALVG
strain CFT073         DSLLAAFHKE  TGAIDASLTT  ISTVLASVSS  GISAAATTSL  VGAPVSALVG
Group A               DSLLAAFHKE  TGAIDASLTT  ISTVLASVSS  GISAAATTSL  VGAPVSALVG
strain E110019        DSLLAAFHKA  TGAIDASLTT  ISTVLASVSS  GISAAATTSL  VGAPVSALVG
Consensus             DSLLAAFHK-  TGAIDASLTT  ISTVLASVSS  GISAAATTSL  VGAPVSALVG
                                             SEQ ID NO: 445
B-Cell Ep.                         *  *****

401                                                450
strain 536            AVTGIISGIL  EASKQAMFEH  VASKMADVIA  EWEKKHGKNY  FENGYDARHA
strain 536            AVTGIISGIL  EASKQAMFEH  VASKMADVIA  EWEKKHGKNY  FENGYDARHA
strain CFT073         AVTGIISGIL  EASKQAMFEH  VASKMADVIA  EWEKKHGKNY  FENGYDARHA
Group A               AVTGIISGIL  EASKQAMFEH  VASKMADVIA  EWEKKHGKNY  FENGYDARHA
strain E110019        AVTGIISGIL  EASKQAMFEH  VASKMADVIA  EWEKKHGKNY  FENGYDARHA
Consensus             AVTGIISGIL  EASKQAMFEH  VASKMADVIA  EWEKKHGKNY  FENGYDARHA
B-Cell Ep.                                                *******  *******

451                                                500
strain 536            AFLEDNFKIL  SQYNKEYSVE  RSVLITQQHW  DTLIGELAGV  TRNGDKTLSG
strain 536            AFLEDNFEIL  SQYNKEYSVE  RSVLITQQHW  DTLIGELAGV  TRNGDKTLSG
strain CFT073         AFLEDNFKIL  SQYNKEYSVE  RSVLITQQHW  DTLIGELAGV  TRNGDKTLSG
Group A               AFLEDNFKIL  SQYNKEYSVE  RSVLITQQHW  DMLIGELASV  TRNGDKTLSG
strain E110019        AFLEDNFKIL  SQYNKKYSVE  RSVLITQQHW  DTLIGELAGV  TRNGDKTLSG
Consensus             AFLEDNF-IL  SQYNK-YSVE  RSVLITQQHW  D-LIGELA-V  TRNGDKTLSG
                                             SEQ ID NO: 446          SEQ ID NO: 447
B-Cell Ep.                                                            **  *********

501                                                550
strain 536            KSYIDYYEEG  KRLEKKPDEF  QKQVFDPLKG  NIDLSDSKSS  TLLKFVTPLL
strain 536            KSYIDYYEEG  KRLEKEPDEF  QKQVFDPLKG  NIDLSVIKSS  TLLKFITPLL
strain CFT073         KSYIDYYEEG  KRLEKKPDEF  QKQVFDPLKG  NIDLSDSKSS  TLLKFVTPLL
Group A               KSYIDYYEEG  KRLERRPKEF  QQQIFDPLKG  NIDLSDSKSS  TLLKFVTPLL
strain E110019        KSYIDYYEEG  KRLEKKTDEF  QKQVFDPLKG  NIDLSDSKSS  TLLKFVTPLL
Consensus             KSYIDYYEEG  KRLE----EF  Q-Q-FDPLKG  NIDLS--KSS  TLLKF-TPLL
                                             SEQ ID NO: 448
B-Cell Ep.            ******  **********  **            *******           *

551                                                600
strain 536            TPGEEIRERR  QSGKYEYITE  LLVKGVDKWT  VKGVQDKGSV  YDYSNLIQHA
strain 536            TPGKEIRERR  QSGKYEYITE  LLVKGVDKWT  VKGVQDKGSV  YDYSNLIQHA
strain CFT073         TPGEEIRERR  QSGKYEYITE  LLVKGVDKWT  VKGVQDKGSV  YDYSNLIQHA
Group A               TPGEEIRERR  QSGKYEYITE  LLVKGVDKWT  VKGVQDKGSV  YDYSNLIQHA
strain E110019        TPGEEIRERR  QSGKYEYITE  LLVKGVDKWT  VKGVQDKGAV  YDYSNLIQHA
Consensus             TPG-EIRERR  QSGKYEYITE  LLVKGVDKWT  VKGVQDKG-V  YDYSNLIQHA
                                             SEQ ID NO: 449          SEQ ID NO: 450
B-Cell Ep.            **********  *****                 **********  *

601                                                650
strain 536            SVGNNQYREI  RIESHLGDGD  DKVFLAAGSA  NIYAGKGHDV  VYYDKTDTGY
strain 536            SVGNNQYREI  RIESHLGDGD  DKVFLSAGSA  NIYAGKGHDV  VYYDKTDTGY
strain CFT073         SVGNNQYREI  RIESHLGDGD  DKVFLSAGSA  NIYAGKGHDV  VYYDKTDTGY
Group A               SVGNNQYREI  RIESHLGDGD  DKVFLSAGSA  NIYAGKGHDV  VYYDKTDTGY
strain E110019        SVGNNQYRGI  RIESHLGDGD  DKVFLSAGSA  NIYAGKGHDV  VYYDKTDTGY
Consensus             SVGNNQYR-I  RIESHLGDGD  DKVFL-AGSA  NIYAGKGHDV  VYYDKTDTGY
                                             SEQ ID NO: 451          SEQ ID NO: 452
B-Cell Ep.            *******      ******  *                              ********

651                                                700
strain 536            LTIDGTKATE  AGNYTVTRVL  GGDVKVLQEV  VKEQEVSVGK  RTEKTQYRSY
strain 536            LTIDGTKATE  AGNYTVTRVL  GGDVKVLQEV  VKEQEVSVGK  RTEKTQYRSY
strain CFT073         LTIDGTKATE  AGNYTVTRVL  GGDVKVLQEV  VKEQEVSVGK  RTEKTQYRSY
Group A               LTIDGTKATE  AGNYTVTRVL  GGDVKVLQEV  VKEQEVSVGK  RTEKTQYRSY
strain E110019        LTIDGTKATE  AGNYTVTRVL  GGDVKVLQEV  AKEQEVSVGK  RTEKTQYRSY
Consensus             LTIDGTKATE  AGNYTVTRVL  GGDVK-LQEV  -KEQEVSVGK  RTEKTQYRSY
                                             SEQ ID NO: 453
B-Cell Ep.               *  ******  ****                  ******  *******
```

-continued

```
                701                                                  750
strain 536      EFTHINGTDL TETDNLYSVE ELIGTNRADK FFGSKFTDIF HGADGDDHIE
strain 536      EFTHINGTDL TETDNLYSVE ELIGTNRADK FFGSKFTDIF HGADGDDHIE
strain CFT073   EFTHINGKNL TETDNLYSVE ELIGTTRADK FFGSKFTDIF HGADGDDHIE
Group A         EFTHINGKNL TETDNLYSVE ELIGTTRADK FFGSKFTDIF HGADGDDHIE
strain E110019  EFTHINGKNL TETDNLYSVE ELIGTTRADK FFGSKFTDIF HGADGDDLIE
Consensus       EFTHING--L TETDNLYSVE ELIGT-RADK FFGSKFTDIF HGADGDD-IE
                     SEQ ID NO: 454         SEQ ID NO: 455
B-Cell Ep.      ****  ***                            **********

751                                                  800
strain 536      GNDGNDRLYG DKGNDTLRGG NGDDQLYGGD GNDKLTGGVG NNYLNGGDGD
strain 536      GNDGNDRLYG DKGNDTLRGG NGDDQLYGGD GNDKLTGGVG NNYLNGGDGD
strain CFT073   GNDGNDRLYG DKGNDTLRGG NGDDQLYGGD GNDKLIGGTG NNYLNGGDGD
Group A         GNDGNDRLYG DKGNDTLRGG NGDDQLYGGD GNDKLIGGTG NNYLNGGDGD
strain E110019  GNDGNDRLYG DKGNDTLSGG NGDDQLYGGD GNDKLIGGAG NNYLNGGDGD
Consensus       GNDGNDRLYG DKGNDTL-GG NGDDQLYGGD GNDKL-GG-G NNYLNGGDGD
                  SEQ ID NO: 456    SEQ ID NO: 457   SEQ ID NO: 458
B-Cell Ep.      ********** ********** ********** ********** **********

801                                                  850
strain 536      DELQVQGNSL AKNVLSGGKG NDKLYGSEGA DLLDGGEGND LLKGGYGNDI
strain 536      DELQVQGNSL AKNVLSGGKG NDKLYGSEGA DLLDGGEGND LLKGGYGNDI
strain CFT073   DELQVQGNSL AKNVLSGGKG NDKLYGSEGA DLLDGGEGND LLKGGYGNDI
Group A         DELQVQGNSL AKNVLSGGKG NDKLYGSEGA DLLDGGEGND LLKGGYGNDI
strain E110019  DELQVQGNSL AKNVLSGGKG NDKLYGSEGA DLLDGGEGND LLKGGYGNDI
Consensus       DELQVQGNSL AKNVLSGGKG NDKLYGSEGA DLLDGGEGND LLKGGYGNDI
B-Cell Ep.      *****      ******  ********** ********** ********

851                                                  900
strain 536      YRYLSGYGHH IIDDDGGKDD KLSLADIDFR DVAFKREGND LIMYKAEGNV
strain 536      YRYLSGYGHH IIDDDGGKDD KLSLADIDFR DVAFKREGND LIMYKAEGNV
strain CFT073   YRYLSGYGHH IIDDDEGGKD KLSLADIDFR DVAFRREGND LIMYKAEGNV
Group A         YRYLSGYGHH IIDDEGGKDD KLSLADIDFR DVAFKREGND LIMYKAEGNV
strain E110019  YRYLSGYGHH IIDDDGGKED KLSLADIDFR DVAFKREGND LIMYKAEGNV
Consensus       YRYLSGYGHH IIDD-GGK-D KLSLADIDFR DVAF-REGND LIMYKAEGNV
                                           SEQ ID NO: 459    SEQ ID NO: 460
B-Cell Ep.                  *********  **

901                                                  950
strain 536      LSIGHKNGIT FRNWFEKESG DISNHQIEQI FDKDGRVITP DSLKKAFEYQ
strain 536      LSIGHKNGIT FRNWFEKESG DISNHQIEQI FDKDGRVITP DSLKKAFEYQ
strain CFT073   LSIGHKNGIT FRNWFEKESG DISNHQIEQI FDKDGRVITP DSLKKALEYQ
Group A         LSIGHKNGIT FKNWEEKESD DISNHQIEQI FDKDGRVITP DSLKKAFEYQ
strain E110019  LSIGHENGIT FRNWFEKESG DISNHQIEQI FDKGGRIITP DSLKKALEYQ
Consensus       LSIGH-NGIT F-NWFEKES- D-SNHQIEQI FDK-GR-ITP DSLKKA-EYQ
                                                SEQ ID NO: 461
B-Cell Ep.                  *****  *****    ***** ****   ***

951                                                 1000
strain 536      QSNNQANYVY GEYASTYADL DNLNPLINEI SKIISAAGNF DVKEERSAAS
strain 536      QSNNQANYVY GEYASTYADL DNLNPLINEI SKIISAAGNF DVKEERSAAS
strain CFT073   QSNNKASYVY GNDALAYGSQ DNLNPLINEI SKIISAAGNF DVKEERAAAS
Group A         QSNNKVSYVY GHDASTYGSQ DNLNPLINEI SKIISAAGNF DVKEERSAAS
strain E110019  QRNNKASYVY GNDALAYGSQ DNLNLLINEI SKIISAAGNF DVKEERTAAS
Consensus       Q-NN---YVY G--A--Y--- DNLN-LINEI SKIISAAGNF DVKEER-AAS
                                              SEQ ID NO: 462
B-Cell Ep.      *********    ********                     ** *******

1001             1024
strain 536      LLQLSGNASD FSYGRNSITL TASA
strain 536      LLQLSGNASD FSYGRNSITL TASA
strain CFT073   LLQLSGNASD FSYGRNSITL TASA
Group A         LLQLSGNASD FSYGRNSITL TASA
strain E110019  LLQLSGNASD FSYGRNSITL TTSA
Consensus       LLQLSGNASD FSYGRNSITL T-SA
                     SEQ ID NO: 463
B-Cell Ep.      *****  ***

B-Cell Epitopes

SEQ ID NO: 464     QSAKQSAANKLHSAGQSTKDALKKAAEQTRNA
SEQ ID NO: 465     DYKGQGSS
SEQ ID NO: 466     QYDEKNGTAI
SEQ ID NO: 467     QKAGNKLGGSAENIGDNLGK
SEQ ID NO: 468     IKKQSGSNVSSSEL
SEQ ID NO: 469     ADADTGTKAAAG
SEQ ID NO: 470     AQGLSTSAA
SEQ ID NO: 471     SGISAA
SEQ ID NO: 472     EKKHGENYFENGYDA
SEQ ID NO: 473     GVTRNGDKTLS
```

```
SEQ ID NO: 474      DYYEEGKRLEKKPDEFQK
SEQ ID NO: 475      IDLSDSKS
SEQ ID NO: 476      LTPGEEIRERRQSGKY
SEQ ID NO: 477      VKGVQDKGSVY
SEQ ID NO: 478      SVGNNQY
SEQ ID NO: 479      HLGDGDD
SEQ ID NO: 480      YDKTDTGYL
SEQ ID NO: 481      GTKATEAGNY
SEQ ID NO: 482      EVSVGKRTEKTQY
SEQ ID NO: 483      GTDLTET
SEQ ID NO: 484      HGADGDDHIEGNDGNDRLYGDKGNDTLRGGNGDDQLYGGDGNDKLTGGVGNNYLNGGDGDDELQV
SEQ ID NO: 485      LSGGKGNDKLYGSEGADLLDGGEGNDLLKGGYGN
SEQ ID NO: 486      IDDDGGKDDKL
SEQ ID NO: 487      EKESGDISNH
SEQ ID NO: 488      GRVITPDSLK
SEQ ID NO: 489      EYQQSNNQANYV
SEQ ID NO: 490      YASTYADL
SEQ ID NO: 491      NFDVKEERS
SEQ ID NO: 492      GNASDFSY
```

Upec948 Protein

'upec948' protein from *E. coli* UPEC is also known as: 'c0975 from CFT073.

When used according to the present invention, upec948 protein may take various forms. Preferred upec948 sequences have 50% or more identity (e.g. 60%, 70%, 80%, 90%, 95%, 96%, 97%, 98%, 99% or more) to SEQ ID NOs 82-84. This includes variants (e.g. allelic variants, homologs, orthologs, paralogs, mutants etc).

Other preferred upec948 sequences comprise at least n consecutive amino acids from SEQ ID NOs 82-84, wherein n is 7 or more (eg. 8, 10, 12, 14, 16, 18, 20, 25, 30, 35, 40, 50, 60, 70, 80, 90, 100, 150, 200, 250 or more). Preferred fragments comprise an epitope or immunogenic fragment from upec948. Other preferred fragments lack one or more amino acids (e.g. 1, 2, 3, 4, 5, 6, 7, 8, 9, 10, 15, 20, 25 or more) from the C-terminus and/or the N-terminus of SEQ ID NOs 82-84. Exemplary fragments are the conserved fragments SEQ ID NOs identified in the sequence alignment below.

```
Group A: strain RS218,    (SEQ ID NO: 82)
E2348-69 and CFT073
Strain HS                 (SEQ ID NO: 83)
Strain B and C            (SEQ ID NO: 84)

1                                                    50
Group A              VSLSTALRMT CRRRLLSLIV GPASLNRFIP PFQHFGQRHN VSNGWRPVKN
strain HS            VSLSTALRMT CRRRLLSLIV GPASLNRFIP PFQHFGQRHN VSNGWRPVKD
strain B and C       VSLSTALRMT CRRRLLSLIV GPASLNRFIP PVQHFGQRHN VSNGWRPVKN
Consensus            VSLSTALRMT CRRRLLSLIV GPASLNRFIP P-QHFGQRHN VSNGWRPVK-
                         SEQ ID NO: 493                     SEQ ID NO: 494
B-Cell Ep.                                              **  **********

51                                                   100
Group A              GGDICHQIVN RQAVGKPAST DFFNKKVTTS TDMAVRSAGS ISAISCAVSA
strain HS            GGDICHQIVN RQAVGKPAST DFFNKKVTTS TDMAVRSAGS ISAISCAVSA
strain B and C       GGDICHQIVN RQAVGKPAST DFFNKKVTTS TDMAVRSAGS ISAISCAVSA
Consensus            GGDICHQIVN RQAVGKPAST DFFNKKVTTS TDMAVRSAGS ISAISCAVSA
                                       SEQ ID NO: 495
B-Cell Ep.              ***        ******** **   **** ******

101                                                  150
Group A              GLEMRGITVI IAFTSISIMA CRRVPRSAPD CGLRSTISVI SVLPRLMGVS
strain HS            GLEMRGITVI IAFTSISIMA CRRVPRSAPD CGLRSTISVI SVLPRMMGVS
strain B and C       GLEMRGITVI IAFTSISIMA CRRVPRSAPD CGLRSTISVI SVLPRMMGVS
Consensus            GLEMRGITVI IAFTSISIMA CRRVPRSAPD CGLRSTISVI SVLPR-MGVS
B-Cell Ep.                                 ******* **

151
Group A              S
strain HS            S
strain B and C       S
Consensus            S B-Cell Epitopes SEQ ID NO: 496      HNVSNGWRPVKNGGD
SEQ ID NO: 497      AVGKPASTDF
SEQ ID NO: 498      VTTSTDMAVR
SEQ ID NO: 499      VPRSAPDCG
```

Upec1232 Protein

'upec1232' protein from *E. coli* UPEC is disclosed in reference 6 (SEQ ID 138) is also known as: 'c1275 from CFT073.

When used according to the present invention, upec1232 protein may take various forms. Preferred upec1232 sequences have 50% or more identity (e.g. 60%, 70%, 80%, 90%, 95%, 96%, 97%, 98%, 99% or more) to SEQ ID NOs 85-91. This includes variants (e.g. allelic variants, homologs, orthologs, paralogs, mutants etc).

Other preferred upec1232 sequences comprise at least n consecutive amino acids from SEQ ID NOs 85-91, wherein n is 7 or more (eg. 8, 10, 12, 14, 16, 18, 20, 25, 30, 35, 40, 50, 60, 70, 80, 90, 100, 150, 200, 250 or more). Preferred fragments comprise an epitope or immunogenic fragment from upec1232. Other preferred fragments lack one or more amino acids (e.g. 1, 2, 3, 4, 5, 6, 7, 8, 9, 10, 15, 20, 25 or more) from the C-terminus and/or the N-terminus of SEQ ID NOs 85-91. Exemplary fragments are the conserved fragments SEQ ID NOs identified in the sequence alignment below.

```
strain H10407    (SEQ ID NO: 85)
strain H10407    (SEQ ID NO: 86)
strain B7A       (SEQ ID NO: 87)
strain O42       (SEQ ID NO: 88)
strain CFT073    (SEQ ID NO: 89)
strain O42       (SEQ ID NO: 90)
strain CFT073    (SEQ ID NO: 91)

1                                                      50
strain H10407    MIHLFKTCMI TTFILGLMWS APLRAQDQRY ISIRNTDTIW LPGNICAYQF
strain H10407    MIHLFKTCMI TTFILGLMWS APLRAQDQRY ISIRNTDTIW LPGNICAYQF
strain B7A       MIHLFKTCMI TAFILGLTWS APLRAQDQRY ISIRNTDTIW LPGNICAYQF
strain O42       MIHLFKTCMI TAFILGLTWS APLRAQDQRY ISIRNTDTIW LPGNICAYQF
strain CFT073    MIHLFKTCMI TAFILGLTWS APLRAQDQRY ISIRNTDTIW LPGNICAYQF
strain O42       MIHLFKTCMI TAFILGLTWS APLRAQDQRY ISIRNTDTIW LPGNICAYQF
strain CFT073    MIHLFKTCMI TAFILGLTWS APLRAQDQRY ISIRNTDTIW LPGNICAYQF
strain H10407    MIHLFKTCMI TTFILGLMWS APLRAQDQRY ISIRNTDTIW LPGNICAYQF
strain H10407    MIHLFKTCMI TTFILGLMWS APLRAQDQRY ISIRNTDTIW LPGNICAYQF
strain B7A       MIHLFKTCMI TAFILGLTWS APLRAQDQRY ISIRNTDTIW LPGNICAYQF
strain O42       MIHLFKTCMI TAFILGLTWS APLRAQDQRY ISIRNTDTIW LPGNICAYQF
strain CFT073    MIHLFKTCMI TAFILGLTWS APLRAQDQRY ISIRNTDTIW LPGNICAYQF
strain O42       MIHLFKTCMI TAFILGLTWS APLRAQDQRY ISIRNTDTIW LPGNICAYQF
strain CFT073    MIHLFKTCMI TAFILGLTWS APLRAQDQRY ISIRNTDTIW LPGNICAYQF
Consensus        MIHLFKTCMI T-FILGL-WS APLRAQDQRY ISIRNTDTIW LPGNICAYQF
                 SEQ ID NO: 500                   SEQ ID NO: 501

51                                                    100
strain H10407    RLDNGGNDEG FGPLTITLQL KDKYGQTLVT RKMETEAFGD SNATRTTDAF
strain H10407    RLDNGGNDEG FGPLTITLQL KDKYGQTLVT RKMETEAFGD SNATRTTDAF
strain B7A       RLDNGGNDEG FGPLTITLQL KDKYGQTLVT RKMETEAFGD SNATRTTDAF
strain O42       RLDNGGNDEG FGPLTITLQL KDKYGQTLVT RKMETEAFGD SNATRTTDAF
strain CFT073    RLDNGGNDEG FGPLTITLQL KDKYGQTLVT RKMETEAFGD SNATRTTDAF
strain O42       RLDNGGNDEG FGPLTITLQL KDKYGQTLVT RKMETEAFGD SNATRTTDAF
strain CFT073    RLDNGGNDEG FGPLTITLQL KDKYGQTLVT RKMETEAFGD SNATRTTDAF
Consensus        RLDNGGNDEG FGPLTITLQL KDKYGQTLVT RKMETEAFGD SNATRTTDAF
B-Cell Ep.       ******** **                      ****** ******

101                                                   150
strain H10407    LETECVENVA TTEIIKATEE SNGHRVSLPL SVFDPQDYHP LLITVSGKNV
strain H10407    LETECVENVA TTEIIKATEE SNGHRVSLPL SVFNPQDYHP LLITVSGKNV
strain B7A       LETECVENVA TTEIIKATEE SNGHRVSLPL SVFNPQDYHP LLITVSGKNV
strain O42       LETECVENVA TTEIIKATEE SNGHRVSLPL SVFNPQDYHP LLITVSGKNV
strain CFT073    LETECVENVA TTEIIKATEE SNGHRVSLPL SVFDPQDYHP LLITVSGKNV
strain O42       LETECVENVA TTEIIKATEE SNGHRVSLPL SVFDPQDYHP LLITVSGKNV
strain CFT073    LETECVENVA TTEIIKATEE SNGHRVSLPL SVFDPQDYHP LLITVSGKNV
Consensus        LETECVENVA TTEIIKATEE SNGHRVSLPL SVF-PQDYHP LLITVSGKNV
                                                      SEQ ID NO: 502
B-Cell Ep.                       ***** *****  ******

151
strain H10407    N
strain H10407    N
strain B7A       N
strain O42       N
strain CFT073    N
strain O42       N
strain CFT073    N
Consensus        N B-Cell Epitopes
─────────────────
SEQ ID NO: 503    DNGGNDEGFG
SEQ ID NO: 504    TEAFGDSNATRT
SEQ ID NO: 505    KATEESNGHR
SEQ ID NO: 506    FDPQDY
```

Upec1875 Protein

Type-1 fimbrial protein, A chain precursor, is referred to herein as 'upec1875.' 'upec1875' protein from *E. coli* UPEC is disclosed in reference 6 (SEQ ID 221) is also known as: 'orf1642' from *E. coli* NMEC strain IHE3034, 'c1936' from CFT073.

When used according to the present invention, upec1875 protein may take various forms. Preferred upec1875 sequences have 50% or more identity (e.g. 60%, 70%, 80%, 90%, 95%, 96%, 97%, 98%, 99% or more) to SEQ ID NOs 92-98. This includes variants (e.g. allelic variants, homologs, orthologs, paralogs, mutants etc).

Other preferred upec1875 sequences comprise at least n consecutive amino acids from SEQ ID NOs 92-98, wherein n is 7 or more (eg. 8, 10, 12, 14, 16, 18, 20, 25, 30, 35, 40, 50, 60, 70, 80, 90, 100, 150, 200, 250 or more). Preferred fragments comprise an epitope or immunogenic fragment from upec1875. Other preferred fragments lack one or more amino acids (e.g. 1, 2, 3, 4, 5, 6, 7, 8, 9, 10, 15, 20, 25 or more) from the C-terminus and/or the N-terminus of SEQ ID NOs 92-98. Exemplary fragments are the conserved fragments SEQ ID NOs identified in the sequence alignment below.

```
Group A: strain E22,            (SEQ ID NO: 92)
E110019, B7A and B171
Group B: strain EDL933,         (SEQ ID NO: 93)
SAKAI, EC508, EC869,
EC4024, EC4042, EC4045,
EC4076, EC4113, EC4115,
EC4196, EC4206, EC4401,
EC4486, EC4501 and
TW14588
strain SECEC                    (SEQ ID NO: 94)
strain O42                      (SEQ ID NO: 95)
Group C: strain IHE3034,        (SEQ ID NO: 96)
RS218, UTI89, F11 and
APEC01
strain CFT073                   (SEQ ID NO: 97)
strain E2348-69                 (SEQ ID NO 98)
```

```
                   1                                                 50
Group A            MKLKHVGMIV VSVLAMSSAA VSAAEGDESV TTTVNGGVIH FKGEVVNAAC
Group B            MKLKHVGMIV VSVLAMSSAA VSAAEGDESV TTTVNGGVIH FKGEVVNAAC
strain SECEC       MKLKHVGMIV VSVLAMSSAA VSAAEGDESV TTTVNGGVIH FKGEVVNAAC
strain O42         MKLKHVGMIV VSVLAMSSAA VSAAEGDESV TTTVNGGVIH FKGEVVNAAC
Group C            MKLKHVGIIV VSVLAMSSAA VSAAEGDESV TTTVNGGVIH FKGEVVNAAC
strain CFT073      MKLKHVGIIV VSVLAMSSAA VSAAEGDESV TTTVNGGVIH FKGEVVNAAC
strain E2348-69    MKLKHVGIIV VSVLAMSSAA VSAAEGDESV MTTVNGGVIH FKGEVVNAAC
Consensus          MKLKHVG-IV VSVLAMSSAA VSAAEGDESV -TTVNGGVIH FKGEVVNAAC
                              SEQ ID NO: 507           SEQ ID NO: 508
B-Cell Ep.                                    ********** ****

51                                                100
Group A            AIDSESMNQT VELGQVRSSR LAKAGDLSSA VGFNIKLNDC DTNVSSNAAV
Group B            AIDSESMNQT VELGQVRSSR LAKAGDLSSA VGFNIKLNDC DTNVSSNAAV
strain SECEC       AIDSESMNQT VELGQVRSSR LAKAGDLSSA VGFNIKLNDC DTNVSSNAAV
strain O42         AIDSESMNQT VELGQVRSSR LAKAGDLSSA VGFNIKLNDC DTNVSSNAAV
Group C            AIDSESMNQT VELGQVRSSR LAKAGDLSSA VGFNIKLNDC DTNVSSNAAV
strain CFT073      AIDSESMNQT VELGQVRSSR LAKAGDLSSA VGFNIKLNDC DTNVSSNAAV
strain E2348-69    AIDSESMNQT VELGQVRSSR LAKAGDLSSA VGFNIKLNDC DTNVSSNAAV
Consensus          AIDSESMNQT VELGQVRSSR LAKAGDLSSA VGFNIKLNDC DTNVSSNAAV
B-Cell Ep.                                                      *******

101                                               150
Group A            AFLGTTVTSN DDTLALQSSA AGSAQNVGIQ ILDRTGEVLI LDGATFSAKT
Group B            AFLGTTVTSN DDTLALQSSA AGSAQNVGIQ ILDRTGEVLI LDGATFSAKT
strain SECEC       AFLGTTVTSN DDTLALQSSA AGSAQNVGIQ ILDRTGEVLI LDGATFSAKT
strain O42         AFLGTTVTSN DDTLALQSSA AGSAQNVGIQ ILDRTGEVLI LDGGTFSAKT
Group C            AFLGTTVTSN DDTLALQSSA AGSAQNVGIQ ILDRTGEVLV LDGATFSAKT
strain CFT073      AFLGTTVTSN DDTLALQSSA AGSAQNVGIQ ILDSTGEVLV LDGATFSAKT
strain E2348-69    AFLGTTVTSN DDTLALQSSA AGSAQNVGIQ ILDRTGEVLV LDGATFSAKT
Consensus          AFLGTTVTSN DDTLALQSSA AGSAQNVGIQ ILD-TGEVL- LDG-TFSAKT
B-Cell Ep.                    ***** *****  ** ******

151                                        187
Group A            DLIDGTNILP FQARYIALGQ SVAGTANADA TFKVQYL
Group B            DLIDGTNILP FQARYIALGQ SVAGTANADA TFKVQYL
strain SECEC       DLIDGTNILP FQARYIALGQ SVAGTANADA TFKVQYL
strain O42         DLIDGTNILP FQARYIALGQ SVAGTANADA TFKVQYL
Group C            DLIDGTNILP FQARYIALGQ SVAGTANADA TFKVQYL
strain CFT073      DLIDGTNILP FQARYIALGQ SVAGTANADA TFKVQYL
strain E2348-69    DLIDGTNILS FQARYIALGQ SVAGTANADA TFKVQYL
Consensus          DLIDGTNIL- FQARYIALGQ SVAGTANADA TFKVQYL
                       SEQ ID NO: 509    SEQ ID NO: 510
B-Cell Ep.                    **********
```

B-Cell Epitopes

```
SEQ ID NO: 511    VSAAEGDESVTTTV
SEQ ID NO: 512    DTNVSSN
SEQ ID NO: 513    TVTSNDDTLA
SEQ ID NO: 514    SAAGSAQN
SEQ ID NO: 515    SVAGTANADA
```

Upec2820 Protein

YapH homolog protein is referred to herein as 'upec2820.' 'upec2820' protein from *E. coli* NMEC is disclosed in reference 6 (SEQ ID 307) is also known as: 'c2895' from CFT073.

When used according to the present invention, upec2820 protein may take various forms. Preferred upec2820 sequences have 50% or more identity (e.g. 60%, 70%, 80%, 90%, 95%, 96%, 97%, 98%, 99% or more) to SEQ ID NOs 99-100. This includes variants (e.g. allelic variants, homologs, orthologs, paralogs, mutants etc).

Other preferred upec2820 sequences comprise at least n consecutive amino acids from SEQ ID NOs 99-100, wherein n is 7 or more (eg. 8, 10, 12, 14, 16, 18, 20, 25, 30, 35, 40, 50, 60, 70, 80, 90, 100, 150, 200, 250 or more). Preferred fragments comprise an epitope or immunogenic fragment from upec2820. Other preferred fragments lack one or more amino acids (e.g. 1, 2, 3, 4, 5, 6, 7, 8, 9, 10, 15, 20, 25 or more) from the C-terminus and/or the N-terminus of SEQ ID NOs 99-100. Exemplary fragments are the conserved fragments SEQ ID NOs identified in the sequence alignment below.

```
                 strain CFT073    (SEQ ID NO: 99)
                 strain SECEC     (SEQ ID NO: 100)

1                                                         50
                 strain CFT073    MNKVYKVIWN HTTQKWDVVS ELTSCRKKCK STRLGIALSA MVLGGAIAIN
                 strain SECEC     MNKIYKVIWN HTTQKWDVVS ELTSCRKKCK STRLGIALSA MVLGGAIAIN
                 Consensus        MNK-YKVIWN HTTQKWDVVS ELTSCRKKCK STRLGIALSA MVLGGAIAIN
                                             SEQ ID NO: 516

51                                                        100
                 strain CFT073    CNNAMADVIL SPDWRPGTNN SGVGAATVSG KTEYITGPNV VQSGGGSLIW
                 strain SECEC     CNNAMADVIL SPDWRPGTNN SGVGAATVSG KTEYITGPNV VQSGGGSLIW
                 Consensus        CNNAMADVIL SPDWRPGTNN SGVGAATVSG KTEYITGPNV VQSGGGSLIW
                 B-Cell Ep.                  ********* ********** ********** *****

101                                                       150
                 strain CFT073    MTVEQAILNG YTTGDNLSGL IYVNTGEKTK TITVKDEVTG ASQTLQVFDT
                 strain SECEC     MTVEQAILNG YTTGDNLSGL IYVNTGEKTK TITVKDEVTG AYQTLQVFDT
                 Consensus        MTVEQAILNG YTTGDNLSGL IYVNTGEKTK TITVKDEVTG A-QTLQVFDT
                 B-Cell Ep.                   ******              ****** ********** ***

151                                                       200
                 strain CFT073    DSFSQRDAGT GGNETIPGFS GTADFFNATR FVTANNGGTA ILDVGSPAIG
                 strain SECEC     DSFSQRDAGT GGNETIPGFS GTADFFNATR FVTANNGGTA ILDVGSPAIG
                 Consensus        DSFSQRDAGT GGNETIPGFS GTADFFNATR FVTANNGGTA ILDVGSPAIG
                                            SEQ ID NO: 517
                 B-Cell Ep.       ********** ********** **         *******

201                                                       250
                 strain CFT073    NFFKNTQLAV ADGEGSSVVW NSVNDFYFQP GATMQGGGVT QKIIDSMKYA
                 strain SECEC     NFFKNTQLAV ADGEGSSVVW NSVNDFYFQP GATMQGGGVT QKIIDSMKYA
                 Consensus        NFFKNTQLAV ADGEGSSVVW NSVNDFYFQP GATMQGGGVT QKIIDSMKYA
                 B-Cell Ep.                ** ********                       **********

251                                                       300
                 strain CFT073    GTITDWAGKV HHINSLDDLK QYNQYLIKSL EDKTLSYKQY DAEFNKALIV
                 strain SECEC     GTITDWAGKV HHINSLDDLK QYNQYLIKSL EDKTLSYKQY DAEFNKALIV
                 Consensus        GTITDWAGKV HHINSLDDLK QYNQYLIKSL EDKTLSYKQY DAEFNKALIV 301                                                       350
                 strain CFT073    TKHNYNVDMT AGGRIDSTPY KENVGLLAVL HATNNARAIL GKTGKLTGVL
                 strain SECEC     TKHNYNVDMT AGGRIDSTPY KENVGLLAVL HATNNARAIL GKTGKLTGVL
                 Consensus        TKHNYNVDMT AGGRIDSTPY KENVGLLAVL HATNNARAIL GKTGKLTGVL
                 B-Cell Ep.                   *** ********** **

351                                                       400
                 strain CFT073    PAYGNGGGIV ATNGGTGVNE GVIDAIGTEM IAYQDSTIVN DGTLFVWDNN
                 strain SECEC     PAYGNGGGIV ATNGGTGVNE GVIDAIGTEM IAYQDSTIVN DGTLFVWDNN
                 Consensus        PAYGNGGGIV ATNGGTGVNE GVIDAIGTEM IAYQDSTIVN DGTLFVWDNN
                 B-Cell Ep.       ********** **********  *                             *

401                                                       450
                 strain CFT073    DKYALQAEGM VAGSNGSSAI NNGVINIRPF KNAFAPEGIN TAIVVSNGGM
                 strain SECEC     DKYALQAEGM VAGSNGSSAI NNGVINIRPF KNAFAPEGIN TAIVVSNGGM
                 Consensus        DKYALQAEGM VAGSNGSSAI NNGVINIRPF KNAFAPEGIN TAIVVSNGGM
```

-continued

```
B-Cell Ep.                    *****   * **********           *******         ***

451                                                500
strain CFT073                 ATNKGTINIT ADASTNDNNG KTRGVNVGAG GSFINSAFGS INVGIAEDKT
strain SECEC                  ATNKGTINIT ADASTNDNNG KTRGVNVGAG GSFINSAFGS INVGIAEDKT
Consensus                     ATNKGTINIT ADASTNDNNG KTRGVNVGAG GSFINSAFGS INVGIAEDKT
B-Cell Ep.                    ********** ********** **********                *****

501                                                550
strain CFT073                 ATHSAVGSVA IEVQNGANKV VNEGTIFLGR GAQGNYGILA KDAGTVDVVN
strain SECEC                  ATHSAVGSVA IEVQNGANKV VNEGTIFLGR GAQGNYGILA KDAGSVDVVN
Consensus                     ATHSAVGSVA IEVQNGANKV VNEGTIFLGR GAQGNYGILA KDAG-VDVVN
B-Cell Ep.                    ******      *******  *                          *******

551                                                600
strain CFT073                 KGTITIDGHD SDAPALNVGM LANNSSGMKN SGIINVNGLN STGLQVINAG
strain SECEC                  KGTITIDGYD SDAPALNVGM LANNSSGMKN SGIINVNGLN STGLQVINAG
Consensus                     KGTITIDG-D SDAPALNVGM LANNSSGMKN SGIINVNGLN STGLQVINAG
                              SEQ ID NO: 518          SEQ ID NO: 519
B-Cell Ep.                     ******* *****

601                                                650
strain CFT073                 QLNSDGTINV GGKGISSGFR NYGAWVEGAG SNVNVSGKIS LAGTGAVGVF
strain SECEC                  QLNSDGTINV GGEGISSGFR NYGAWVEGAR SNVNVSGKIN LSGTGAVGVF
Consensus                     QLNSDGTINV GG-GISSGFR NYGAWVEGA- SNVNVSGKI- L-GTGAVGVF
                                        SEQ ID NO: 520
B-Cell Ep.                    ********** *******    *******  *****

651                                                700
strain CFT073                 AKDGGSLTLS GNGAVLFGSS DQIGFYVYGK DSAIHNTGSG VMDVSTENST
strain SECEC                  AKDGGSLTLS GNGAVLFGSS DQIGFYVYGK DSAIHNTGSG VMDVSTENST
Consensus                     AKDGGSLTLS GNGAVLFGSS DQIGFYVYGK DSAIHNTGSG VMDVSTENST
                                   SEQ ID NO: 521
B-Cell Ep.                    **********                       ********* *******

701                                                750
strain CFT073                 LFRIASGATF QGTADASSAL TASGKNSYAL IATGKSDGGV ASTVTSGGMT
strain SECEC                  LFRIASGATF QGTADASSAL TASGKNSYAL IATGKSDGGV ASTVTSGGMT
Consensus                     LFRIASGATF QGTADASSAL TASGKNSYAL IATGKSDGGV ASTVTSGGMT
B-Cell Ep.                     *** ********** ******           ******** *******

751                                                800
strain CFT073                 INLTGEGATA TLIEGGAQGT IESNAIINMD NASAIAGIAD GNGYDISGKL
strain SECEC                  INLTGEGATA TLIEGGAQGT IESNAIINMD NASAIAGIAD GNGYDISGKL
Consensus                     INLTGEGATA TLIEGGAQGT IESNAIINMD NASAIAGIAD GNGYDISGKL
B-Cell Ep.                     ******* ********** **            **** ******

801                                                850
strain CFT073                 INPKDKTTLL TAGAQLSSTQ DKVTGYIARN GATLNNTGNI IFTGKNTVGV
strain SECEC                  INPKDKTTLL TAGAQLSSTQ DKVTGYIARN GATLNNTGNI IFTGKNTVGV
Consensus                     INPKDKTTLL TAGAQLSSTQ DKVTGYIARN GATLNNTGNI IFTGKNTVGV
B-Cell Ep.                    ********   ****** ****                             ****

851                                                900
strain CFT073                 RVEEGAVGTN SGNITVQDGG VGLIANATQD VTTINNSGNL VLKGGDNANR
strain SECEC                  RVEEGAVGTN SGNITVQDGG VGLIANATQD VTTINNSGNL VLKGGDNANR
Consensus                     RVEEGAVGTN SGNITVQDGG VGLIANATQD VTTINNSGNL VLKGGDNANR
B-Cell Ep.                    ********** *********            *** ******        ******

901                                                950
strain CFT073                 TTGIKASGTT TTVNMTAGTI SLQGQGAIGV EASNKGTVNL DGSAVPNFAA
strain SECEC                  TTGIKASGTT TTVNMTAGTI SLQGQGAIGV EASNKGTVNL DGSAVPNFAS
Consensus                     TTGIKASGTT TTVNMTAGTI SLQGQGAIGV EASNKGTVNL DGSAVPNFA-
B-Cell Ep.                    ********** *****               **** ********** **********

951                                                1000
strain CFT073                 DGSGITDQIA FRIIGDGATI KTNIAPGTLL DASGERSVLF RIEDGAKQAG
strain SECEC                  DGSGITDQIA FRIIGDGATI KTNIAPGTLL DASGERSVLF RIEDGAKQAG
Consensus                     DGSGITDQIA FRIIGDGATI KTNIAPGTLL DASGERSVLF RIEDGAKQAG
                                        SEQ ID NO: 522
B-Cell Ep.                    ******         *** *****   ** *****

1001                                               1050
strain CFT073                 SLLMKTSGTG SRGIWATGKG SNVLADAGSD FQILGAQAQG LYVTGGATAT
strain SECEC                  SLLMKTSGTG SRGIWATGKG SNVLADAGSD FQILGAQAQG LYVTGGATAT
Consensus                     SLLMKTSGTG SRGIWATGKG SNVLADAGSD FQILGAQAQG LYVTGGATAT
B-Cell Ep.                                **** ********** ******                *****

1051                                               1100
strain CFT073                 LKQGASVNLV GDGAVVAEVD GNEYALDGSI TQTNTGSVIT NEADISSPLN
strain SECEC                  LKQGASVNLV GDGAVVAEVD GNEYALDGSI TQTNTGSVIT NEADISSPLN
```

```
                                -continued
Consensus      LKQGASVNLV GDGAVVAEVD GNEYALDGSI TQTNTGSVIT NEADISSPLN
B-Cell Ep.     ****       ******* ******* ** ********* *********

1101                                       1150
strain CFT073  NAKGFITRNQ GLLINNGNID FTTGTDNIGV WVDNGRFENT GSRIAVNGVA
strain SECEC   NAKGFITRNQ GLLINSGNID FTTGTDNIGV WVDNGRFENT GSRIAVNGVA
Consensus      NAKGFITRNQ GLLIN-GNID FTTGTDNIGV WVDNGRFENT GSRIAVNGVA
                                    SEQ ID NO: 523
B-Cell Ep.     *              ** *******  ****** ****

1151                                       1200
strain CFT073  LFVEGAQSQI TSTGGDIVAV DGEAAIKLGA GASLNLAGSG LGTIEGQKNA
strain SECEC   LFVEGEHAQI TSTGGDIVAV DGEAAIKLGA GASLNLAGSG LGTIEGQKNA
Consensus      LFVEG---QI TSTGGDIVAV DGEAAIKLGA GASLNLAGSG LGTIEGQKNA
                                    SEQ ID NO: 524
B-Cell Ep.     **** **********                            *********

1201                                       1250
strain CFT073  HGILLDTGAV GLVIDGAKIN VNAAGAVGHG IENRAEIEGI QLTNTTEINV
strain SECEC   HGILLDTGAV GLVIDGAKIN VNAAGAVGHG IENRAEIEGI QLTNTTEINV
Consensus      HGILLDTGAV GLVIDGAKIN VNAAGAVGHG IENRAEIEGI QLTNTTEINV
B-Cell Ep.                                      ******* ******

1251                                       1300
strain CFT073  ADGIGVRTSA SLAKTNSGTI NVDGSGIALA FQKADGSETD NNLDMSDSAG
strain SECEC   ADGIGVRTSA SLAKTNSGTI NVDGSGIALA FQKADGSETD NNLDMSDSGG
Consensus      ADGIGVRTSA SLAKTNSGTI NVDGSGIALA FQKADGSETD NNLDMSDS-G
B-Cell Ep.                ********** ****         ******** ******

1301                                       1350
strain CFT073  LVINLKGTDG TGIFANTKDG AVVKSGASVN VIQADGGSAL VVNNAASEVV
strain SECEC   LVINLKGTGG TGIFANTKDG AVVKSGASVN VTQADGGSAL VVNNAASEVV
Consensus      LVINLKGT-G TGIFANTKDG AVVKSGASVN V-QADGGSAL VVNNAASEVV
                                    SEQ ID NO: 525      SEQ ID NO: 526
B-Cell Ep.               **** ********** ****           ******

1351                                       1400
strain CFT073  QSGNLISASL SHAVVDASKA QSFTNKGQIK AASTTGTAMA FDDAVNTTVL
strain SECEC   QSGNLISASL SHAVVDASKA QSFTNKGQIK AASATGTAMA FDDAVNTTVL
Consensus      QSGNLISASL SHAVVDASKA QSFTNKGQIK AAS-TGTAMA FDDAVNTTVL
                                                         SEQ ID NO: 527
B-Cell Ep.                **** ********** **********            **

1401                                       1450
strain CFT073  NDSGAEIQGV VALNGGDNTF TNKGSITGTV SAKEGNNTFL FDDGSTLTGE
strain SECEC   NDSGAEIQGV VALNGGDNTF TNKGSITGTV SAKEGNNTFL FDDGSILTGE
Consensus      NDSGAEIQGV VALNGGDNTF TNKGSITGTV SAKEGNNTFL FDDGS-LTGE
B-Cell Ep.     *******    ******** ********** ******     ******

1451                                       1500
strain CFT073  VTAGNGNNNV TLNGKTHVDQ VTAGTGKNTF TIKGEGATWN LLDGGQGDSD
strain SECEC   VAAGNGNNNV TLNGKAHVDK VTAGTGKNTF TIKGEGATWN LLDGGQGDSD
Consensus      V-AGNGNNNV TLNGK-HVD- VTAGTGKNTF TIKGEGATWN LLDGGQGDSD
                         SEQ ID NO: 528               SEQ ID NO: 529
B-Cell Ep.     ********** *** ****** ********** *******    *********

1501                                       1550
strain CFT073  SLIFDNAIHT LDSVVKLQNF EHVGLKNSSL VTLKEALVLT DGGNGPGSVD
strain SECEC   SLIFDNAIHT LDSAVKLRNF EHVGLKNSSL VTLKEALVLT DGGTGPGSVD
Consensus      SLIFDNAIHT LDS-VKL-NF EHVGLKNSSL VTLKEALVLT DGG-GPGSVD
                                                         SEQ ID NO: 530
B-Cell Ep.                *                                       **********

1551                                       1600
strain CFT073  IESGSELAII PAVAGNETFD PLLTGKGTLS ARLDADTSAF EFSHNVGDQF
strain SECEC   IESGSELAII PAVAGNETFD PLLTGKGTLS ARLDADTSAF EFSHNVGDQF
Consensus      IESGSELAII PAVAGNETFD PLLTGKGTLS ARLDADTSAF EFSHNVGDQF
                         SEQ ID NO: 531
B-Cell Ep.     ****                            *******

1601                                       1650
strain CFT073  AGTLKLGTSS FALEGLNTSG LTHAMLMSET GNITTVGSGV QQIGGLGFNG
strain SECEC   AGTLKLGTSS FALEGLNTSG LTHAMLMSET GNITTVGSGV QQIGGLGFNG
Consensus      AGTLKLGTSS FALEGLNTSG LTHAMLMSET GNITTVGSGV QQIGGLGFNG
B-Cell Ep.                                                ********* **

1651                                       1700
strain CFT073  GTLIFGSVMP GDTIASNSIE TSAAGTLDIR GKGTIQVTMP DEVINDIPAV
strain SECEC   GTLIFGSVMP GDTIASNSIE TSAAGTLDIR GKGTIQVTMP DEVINDIPAV
Consensus      GTLIFGSVMP GDTIASNSIE TSAAGTLDIR GKGTIQVTMP DEVINDIPAV
B-Cell Ep.                ** ********** ******
```

```
              1701                                       1750
strain CFT073 DTRKNLLEQD DAQTLVTLVN AAGTVTGTGG QLQLVDENGQ AISHSQTFDV
strain SECEC  DTRKNLLEQD DAQTLVTLVN AAGTVTGTGG QLQLVDENGQ AISHSQTFDV
Consensus     DTRKNLLEQD DAQTLVTLVN AAGTVTGTGG QLQLVDENGQ AISHSQTFDV
B-Cell Ep.      **** ***     *******      **** ***      ****

1751                                       1800
strain CFT073 TQGGEVVAQG NYDYKLLGSS DGIKGDGLYI GYGLKSLDLQ GTGDKALVLT
strain SECEC  TQGGEVVAQG NYDYKLLGSS DGVKGDGLYI GYGLKSLDLQ GTGDKALVLT
Consensus     TQGGEVVAQG NYDYKLLGSS DG-KGDGLYI GYGLKSLDLQ GTGDKALVLT
                                                SEQ ID NO: 532
B-Cell Ep.    ********** *          * *****          ** ****

1801                                       1850
strain CFT073 PRANAQGLQT DLGAQLTGAG DLAIEAAGQV VTLSNGGNNY TGDTLVRSGT
strain SECEC  PRANAQGLQT DLGAQLTGAG DLAIEAAGQV VTLSNGGNNY TGDTLVRSGT
Consensus     PRANAQGLQT DLGAQLTGAG DLAIEAAGQV VTLSNGGNNY TGDTLVRSGT
B-Cell Ep.    ********* * *******              ******* ******

1851                                       1900
strain CFT073 LQMANDNVLG ATGNLNVASN AVFRTNGYSQ TVGALQTETG AHIQLDSGSV
strain SECEC  LQMANDNVLG ATGSLNVASN AVFRTDGYSQ TVGALQTETG AHIQLDSGSV
Consensus     LQMANDNVLG ATG-LNVASN AVFRT-GYSQ TVGALQTETG AHIQLDSGSV
                               SEQ ID NO: 533     SEQ ID NO: 534
B-Cell Ep.                             **** **********

1901                                       1950
strain CFT073 LTVSGTQRQP GDDNGGIIEN NVLSGEGTLA VTGSNLTVHG TNIGFTGNAS
strain SECEC  LTVSGTQRQP GDDNGGIIEN NVLTGDGTLA VTGSNLTVHG TNIGFTGNVS
Consensus     LTVSGTQRQP GDDNGGIIEN NVL-G-GTLA VTGSNLTVHG TNIGFTGN-S
                                                          SEQ ID NO: 535
B-Cell Ep.       ******* *******

1951                                       2000
strain CFT073 LTQGALVEMN GAQGLGSQGS ISFESLNDRL AIDIADGSGV SSNLSKSLSG
strain SECEC  LTRGSLVEMN GAQGLGSQGS ISFESLNDRL AIDIADGSGV SSNLSKSLSG
Consensus     LT-G-LVEMN GAQGLGSQGS ISFESLNDRL AIDIADGSGV SSNLSKSLSG
                            SEQ ID NO: 536
B-Cell Ep.              ********* *          ****** *** ******

2001                                       2050
strain CFT073 EGSVGILNTT DLTLSGDNSN FSGEFRVQKD AALRASDEKH LGTGLIDSDG
strain SECEC  KGSVGILNTT DLTLSGDNRN FSGEFRVQKD AALRASDEKH LGTGLIDSDG
Consensus     -GSVGILNTT DLTLSGDN-N FSGEFRVQKD AALRASDEKH LGTGLIDSDG
                SEQ ID NO: 537              SEQ ID NO: 538
B-Cell Ep.    ***        ******** **

2051                                       2100
strain CFT073 VTWLTASGNW LLKNDITGSG ALVKQGAGNL IINHELTYTG DTTVESGVLI
strain SECEC  VTWLTASGNW LLKNDITGSG ALVKQGAGNL IINHELTYTG DTTVENGVLI
Consensus     VTWLTASGNW LLKNDITGSG ALVKQGAGNL IINHELTYTG DTTVE-GVLI
B-Cell Ep.                                                  **** *****

2101                                       2150
strain CFT073 VGDDSVTRAA GATLSGSKNI HVLNGGTLSG LGTVSGQVNN QGTLASLNAL
strain SECEC  VGDDSVTRAA GATLSGSKNI HVLNGGTLSG LGTVSGQVNN QGTLASLNAL
Consensus     VGDDSVTRAA GATLSGSKNI HVLNGGTLSG LGTVSGQVNN QGTLASLNAL
                                       SEQ ID NO: 539
B-Cell Ep.    ******* ******                    ******** ***

2151                                       2200
strain CFT073 SGYETAEVGN FTVGSLTNTG VIRLAGGKTG NTLTVNGDYT GGGTLIINTV
strain SECEC  SGYETAEAGN FTVGSLTNTG VIRLAGGKTG NTLTVNGDYT GGGTLIINTV
Consensus     SGYETAE-GN FTVGSLTNTG VIRLAGGKTG NTLTVNGDYT GGGTLIINTV
                                 SEQ ID NO: 540
B-Cell Ep.    *******              ***** ********** **

2201                                       2250
strain CFT073 LGDDTSTTDK LIVTGNTSGD TGVVVNNVRG QGAQTADGIE IVHVGGQSDG
strain SECEC  LGDDTSATDK LIVTGNTSGD TGVVVNNVRG QGAQTADGIE IVHVGGQSDG
Consensus     LGDDTS-TDK LIVTGNTSGD TGVVVNNVRG QGAQTADGIE IVHVGGQSDG
                           SEQ ID NO: 541
B-Cell Ep.    ******     ***** ***    *** *******         ******

2251                                       2300
strain CFT073 NFRLQNRAVA GAWEYFLHKG NAGGTDGNWY LRSELPPEPQ PQPQPQPQPQ
strain SECEC  NFRLQNRAVA GAWEYFLHKG NAGGTDGNWY LRSELPPE.. ..........
Consensus     NFRLQNRAVA GAWEYFLHKG NAGGTDGNWY LRSELPPE-- ----------
B-Cell Ep.    **             * ********** ******* **********
```

```
                    2301                                                          2350
strain CFT073       PQPQPQPQPQ PQPHPTPDKP VQKVYRPEAG SYIANIAAAN TLFNIRMHDR
strain SECEC        PQPQPQPQPQ PQPHPTPDKP VQKVYRPEAG SYIANIAAAN TLFNIRMHDR
Consensus           PQPQPQPQPQ PQPHPTPDKP VQKVYRPEAG SYIANIAAAN TLFNIRMHDR
                               SEQ ID NO: 542
B-Cell Ep.          ********** ********** **********  *                   **

2351                                                          2400
strain CFT073       EGETYYTDVF TGEKKATSMW MRHIGGHNRW KDSSSQLNTQ SNRYVVQLGG
strain SECEC        EGETYYTDVF TGEKKATSMW MRHIGGHNRW KDSSSQLNTQ SNRYVVQLGG
Consensus           EGETYYTDVF TGEKKATSMW MRHIGGHNRW KDSSSQLNTQ SNRYVVQLGG
B-Cell Ep.          ******      * ******              *** **********

2401                                                          2450
strain CFT073       SIAQWTDGQD RLQQGIMAGY GNEKSSTTSS LSGYKSKGAI NGYSTGLYGT
strain SECEC        SIAQWTDGQD RLQLGIMAGY GNEKSSTTSS LSGYKSKGAI NGYSTGLYGT
Consensus           SIAQWTDGQD RLQ-GIMAGY GNEKSSTTSS LSGYKSKGAI NGYSTGLYGT
                                         SEQ ID NO: 543
B-Cell Ep.          ******** **   ** ********** **********  ***        **

2451                                                          2500
strain CFT073       WQQNDGNDNG AYVDTWIQYG WFNNTVNGEK LAAESWKSRG FTGSVEAGYT
strain SECEC        WQQNDGNDNG AYVDTWIQYG WFNNTVNGEK LAAESWKSRG FTGSVEAGYT
Consensus           WQQNDGNDNG AYVDTWIQYG WFNNTVNGEK LAAESWKSRG FTGSVEAGYT
B-Cell Ep.          ********** **         ****** ********** *******

2501                                                          2550
strain CFT073       FKAGEFTGSQ GSHYDWYIQP QSQITWMNVR ASEHTEKNGT KVQLSGDGNI
strain SECEC        FKAGEFTGSQ GSHYDWYIQP QSQITWMNVR ASEHTEKNGT KVQLSGDGNI
Consensus           FKAGEFTGSQ GSHYDWYIQP QSQITWMNVR ASEHTEKNGT KVQLSGDGNI
                    ****** ***                       ********** **********

2551                                                          2600
strain CFT073       QSRLGVRTYL KGKSASDDNK AHQFEPFVEV NWIHNTRSWG VKMDNTALSQ
strain SECEC        QSRLGVRTYL KGKSASDDNK AHQFEPFVEV NWIHNTRSWG VKMDNTALSQ
Consensus           QSRLGVRTYL KGKSASDDNK AHQFEPFVEV NWIHNTRSWG VKMDNTALSQ
B-Cell Ep.          *          ********** ***                          *****

2601                                                     2649
strain CFT073       DGATNIAEVK TGVQGKLSDN LNVWGNVGVQ AGDKGYSDAQ AMLGIKYIF
strain SECEC        DGATNIAEVK TGVQGKLSDN LNVWGNVGVQ AGDKGYSDAQ AMLGIKYIF
Consensus           DGATNIAEVK TGVQGKLSDN LNVWGNVGVQ AGDKGYSDAQ AMLGIKYIF
B-Cell Ep.          ********   ********           ***  *******
```

B-Cell Epitopes

```
SEQ ID NO: 544      DWRPGTNNSGVGAATVSGKTEYITGPNVVQSGG
SEQ ID NO: 545      YTTGDN
SEQ ID NO: 546      TGEKTKTITVKDEVTGASQ
SEQ ID NO: 547      DSFSQRDAGTGGNETIPGFSGT
SEQ ID NO: 548      TANNGGT
SEQ ID NO: 549      AVADGEGSSV
SEQ ID NO: 550      GATMQGGGVT
SEQ ID NO: 551      DMTAGGRIDSTPYKE
SEQ ID NO: 552      PAYGNGGGIVATNGGTGVNEG
SEQ ID NO: 553      NDKYAL
SEQ ID NO: 554      MVAGSNGSSAI
SEQ ID NO: 555      AFAPEGI
SEQ ID NO: 556      GGMATNKGTINITADASTNDNNGKTRGVNVGAG
SEQ ID NO: 557      AEDKTATHSAV
SEQ ID NO: 558      QNGANKVV
SEQ ID NO: 559      AGTVDVV
SEQ ID NO: 560      TITIDGHDSDAPA
SEQ ID NO: 561      QLNSDGTINVGGKGISSG
SEQ ID NO: 562      AWVEGAGSNVNV
SEQ ID NO: 563      AKDGGSLTLS
SEQ ID NO: 564      SAIHNTGSGVMDVSTE
SEQ ID NO: 565      ATFQGTADASSALTASGKN
SEQ ID NO: 566      TGKSDGGVASTVTSG
SEQ ID NO: 567      TGEGATATLIEGGAQGTIE
SEQ ID NO: 568      GIADGNGYDI
SEQ ID NO: 569      INPKDKTT
SEQ ID NO: 570      QLSSTQDKVT
SEQ ID NO: 571      TVGVRVEEGAVGTNSGNITVQDG
SEQ ID NO: 572      TQDVTTINN
SEQ ID NO: 573      GDNANRTIGIKASGTTTTVNM
SEQ ID NO: 574      AIGVEASNKGTVNLDGSAVPNFAADGSGIT
SEQ ID NO: 575      ATIKTNIA
SEQ ID NO: 576      LLDASGE
SEQ ID NO: 577      SGTGSRGIWATGKGSNVLAD
SEQ ID NO: 578      GATATLKQG
```

-continued

| | |
|---|---|
| SEQ ID NO: 579 | AVVAEVDGNEYALD |
| SEQ ID NO: 580 | SITQTNTGSVITNEADISSPLNN |
| SEQ ID NO: 581 | IDFTTGTDN |
| SEQ ID NO: 582 | GRFENTGSRI |
| SEQ ID NO: 583 | QSQITSTGGDIVAV |
| SEQ ID NO: 584 | LGTIEGQKN |
| SEQ ID NO: 585 | AGAVGHGIENRAE |
| SEQ ID NO: 586 | SLAKTNSGTINVDG |
| SEQ ID NO: 587 | KADGSETDNNLDMS |
| SEQ ID NO: 588 | GTDGTGIFANTKDGAVVK |
| SEQ ID NO: 589 | IQADGG |
| SEQ ID NO: 590 | ASKAQSFTNKGQIKAASTTGTAMA |
| SEQ ID NO: 591 | VLNDSGAEI |
| SEQ ID NO: 592 | LNGGDNTFTNKGSITGTVSAKEGN |
| SEQ ID NO: 593 | STLTGEVTAGNGNNNVTLN |
| SEQ ID NO: 594 | KTHVDQVTAGTGKNTFTIKGEGA |
| SEQ ID NO: 595 | LDGGQGDSDS |
| SEQ ID NO: 596 | DGGNGPGSVDIESG |
| SEQ ID NO: 597 | LDADTSA |
| SEQ ID NO: 598 | NITTVGSGVQQ |
| SEQ ID NO: 599 | MPGDTIASNSIETSAAGT |
| SEQ ID NO: 600 | LEQDDAQ |
| SEQ ID NO: 601 | GTVTGTGG |
| SEQ ID NO: 602 | ENGQAIS |
| SEQ ID NO: 603 | TFDVTQGGEVVAQGN |
| SEQ ID NO: 604 | SDGIKG |
| SEQ ID NO: 605 | LQGTGD |
| SEQ ID NO: 606 | RANAQGLQTD |
| SEQ ID NO: 607 | GAQLTGA |
| SEQ ID NO: 608 | SNGGNNYTGDTLV |
| SEQ ID NO: 609 | GYSQTVGALQTETG |
| SEQ ID NO: 610 | SGTQRQPGDDNGGI |
| SEQ ID NO: 611 | AQGLGSQGSI |
| SEQ ID NO: 612 | ADGSGVSSN |
| SEQ ID NO: 613 | SKSLSGEGS |
| SEQ ID NO: 614 | TLSGDNSNFS |
| SEQ ID NO: 615 | TYTGDTTVE |
| SEQ ID NO: 616 | DSVTRAAGATLSG |
| SEQ ID NO: 617 | TVSGQVNNQGT |
| SEQ ID NO: 618 | GYETAEV |
| SEQ ID NO: 619 | GGKTGNTLTVNGDYTGG |
| SEQ ID NO: 620 | GDDTSTT |
| SEQ ID NO: 621 | NTSGDTGV |
| SEQ ID NO: 622 | VRGQGAQTAD |
| SEQ ID NO: 623 | GGQSDGNF |
| SEQ ID NO: 624 | GNAGGTDGNWY |
| SEQ ID NO: 625 | ELPPEPQPQPQPQPQPQPQPQPQPQPQPHPTPDKPVQKVYRPEAGS |
| SEQ ID NO: 626 | DREGETYY |
| SEQ ID NO: 627 | FTGEKKA |
| SEQ ID NO: 628 | NRWKDSSSQLNTQ |
| SEQ ID NO: 629 | AQWTDGQDRL |
| SEQ ID NO: 630 | GYGNEKSSTTSSLSGYKSKGAINGY |
| SEQ ID NO: 631 | GTWQQNDGNDNGAY |
| SEQ ID NO: 632 | TVNGEKLAAESWKSRGFTGSVEAG |
| SEQ ID NO: 633 | GEFTGSQGSH |
| SEQ ID NO: 634 | ASEHTEKNGTKVQLSGDGNIQ |
| SEQ ID NO: 635 | KGKSASDDNKAHQ |
| SEQ ID NO: 636 | TALSQDGATNIAE |
| SEQ ID NO: 637 | TGVQGKLS |
| SEQ ID NO: 638 | GVQAGDKGYSD |

Upec-5211 Polypeptide

Sel1 repeat-containing protein is referred to herein as 'upec-5211.' 'upec-5211' polypeptide from *E. coli* is also known as: 'c5321' from CFT073; 'ECED1_5081' from ED1a and 'EFER_4303' from *E. fergusonii* ATCC 35469.

When used according to the present invention, upec-5211 polypeptide may take various forms. Preferred upec-5211 sequences have 50% or more identity (e.g., 60%, 65%, 70%, 75%, 80%, 85%, 87.5%, 90%, 91%, 92%, 93%, 94%, 95%, 96%, 97%, 98%, 99%, 99.5% or more) to SEQ ID NOs 653-655. This includes variants (e.g. allelic variants, homologs, orthologs, paralogs, mutants etc).

Other preferred upec-5211 sequences comprise at least n consecutive amino acids from SEQ ID NOs 653-655, wherein n is 7 or more (eg. 8, 10, 12, 14, 16, 18, 20, 25, 30, 35, 40, 50, 60, 70, 80, 90, 100, 150, 200, 250 or more). Preferred fragments comprise an epitope or immunogenic fragment from upec-5211. Other preferred fragments lack one or more amino acids (e.g. 1, 2, 3, 4, 5, 6, 7, 8, 9, 10, 15, 20, 25 or more) from the C-terminus and/or the N-terminus of SEQ ID NOs 653-655. Exemplary fragments are the conserved fragments SEQ ID NOs identified in the sequence alignment below.

| | |
|---|---|
| Strains CFT073 and 83972 | (SEQ ID NO: 653) |
| Strain ED1a | (SEQ ID NO: 654) |

-continued

*Escherichia fergusonii* ATCC 35469 (SEQ ID NO: 655)

```
strain CFT073 and 83972    MKKSLLAVML TGLFALVSLP ALGNVNLEQL KQKAESGEAK AQLELGYRYF
strain ED1a                MKKSLLAVML TGLFALVSLP ALGNVNLEQL KQKAESGEAK AQLELGYRYF
E. fergusonii              MKKSLLAALL TGLFALVSLP ALGNVNFEQL KQKAERGEAK AQLELGYRYF
Consensus                  MKKSLLA +L TGLFALVSLP ALGNVN EQL KQKAE GEAK AQLELGYRYF
                                        SEQ ID NO: 656                SEQ ID NO: 657
B-Cell Ep.                                                                      * strain CFT073 and 83972    QGNETTKDLT QAMDWFRRAA EQGYTPAEYV LGLRYMNGEG VPQDYAQAVI
strain ED1a                QGNETTKDLT LAMDWFRRAA EQGYTPAEYV LGLRYMNGEG VPQDYAQAVI
E. fergusonii              QGNETTKDLT QAIDWFRRAA EQGYTPAEFV LGLRYMNGEG VPKDYAQAVI
Consensus                  QGNETTKDLT  A+DWFRRAA EQGYTPAE+V LGLRYMNGEG VP+DYAQAVI
B-Cell Ep.                 **********      * ****               * ****** strain CFT073 and 83972    WYKKAALKGL PQAQQNLGVM YHEGNGVKVD KAESVKWFRL AAEQGRDSGQ
strain ED1a                WYKKAALKGL PQAQQNLGVM YHEGNGVKVD KAESVKWFRL AAEQGRDSGQ
E. fergusonii              WYKKAALKGL PQAQQNLGVM YHDGKGVKID KAESVKWFRL AAEQGRDSGQ
Consensus                  WYKKAALKGL PQAQQNLGVM YH+G GVK+D KAESVKWFRL AAEQGRDSGQ
                                 SEQ ID NO: 658
B-Cell Ep.                   * ***                           ****** strain CFT073 and 83972    QSMGDAYFEG DGVTRDYVMA REWYSKAAEQ GNVWSCNQLG YMYSRGLGVE
strain ED1a                QSMGDAYFEG DGVTRDYVMA REWYSKAAEQ GNVWSCNQLG YMYSRGLGVE
E. fergusonii              QSMGDAYFEG DGVTRDYVMA REWYSKAAEQ GNVWSCNQLG YIYSKGLGVE
Consensus                  QSMGDAYFEG DGVTRDYVMA REWYSKAAEQ GNVWSCNQLG Y+YS+GLGVE
                                      SEQ ID NO: 659
B-Cell Ep.                 ********          ** * strain CFT073 and 83972    RNDAISAQWY RKSATSGDEL GQLHLADMYY FGIGVTQDYT QSRVLFSQSA
strain ED1a                RNDAISAQWY RKSATSGDEL GQLHLADMYY FGIGVTQDYT QSRVLFSQSA
E. fergusonii              KNDAISAQWY RKSATSGDEL GQLHLADMYY FGIGVTQDYT QSRILFTQSA
Consensus                  +NDAISAQWY RKSATSGDEL GQLHLADMYY FGIGVTQDYT QSR+LF QSA
                                          SEQ ID NO: 660
B-Cell Ep.                   * ********                                *** strain CFT073 and 83972    EQGNSIAQFR LGYILEQGLA GAKEPLKALE WYRKSAEQGN SDGQYYLAHL
strain ED1a                EQGNSIAQFR LGYILEQGLA GAKEPLKALE WYRKSAEQGN SDGQYYLAHL
E. fergusonii              EQGNAIAQYR LGYILEEGLA GAKEPLKALE WYRKSAEQGN AIGQYYLAEI
Consensus                  EQGN+IAQ+R LGYILE+GLA GAKEPLKALE WYRKSAEQGN + GQYYLA +
                                                                 SEQ ID NO: 661
B-Cell Ep.                                     **** strain CFT073 and 83972    YDKGAEGVAK NREQAISWYT KSAEQGDATA QANLGAIYFR LGSEEEHKKA
strain ED1a                YDKGAEGVAK NREQAISWYT KSAEQGDATA QANLGAIYFR LGSEEEHKKA
E. fergusonii              YIRRAEGIPY NREQAIYWYT KSAEQGDTDA QVNLGALLYR HGSEEEQRRA
Consensus                  Y + AEG+   NREQAI WYT KSAEQGD  A Q NLGA +R  GSEEE ++A strain CFT073 and 83972    VEWFRKAAAK GEKAAQFNLG NALLQGKGVK KDEQQAAIWM RKAAEQGLSA
strain ED1a                VEWFRKAAAK GEKAAQFNLG NALLQGKGVK KDEQQAAIWM RKAAEQGLSA
E. fergusonii              VDWYRKAAEE GVAMAQFNLG NALLQGKGVK KDEQQAAIWM RKAAEQGFSS
Consensus                  V+W+RKAA + G     AQFNLG NALLQGKGVK KDEQQAAIWM RKAAEQG S+
                                                               SEQ ID NO: 662
B-Cell Ep.                                                    * *** strain CFT073 and 83972    AQVQLGEIYY YGLGVERDYV QAWAWFDTAS TNDMNLFGTE NRNITEKKLT
strain ED1a                AQVQLGEIYY YGLGVERDYV QAWAWFDTAS TNDMNLFGTE NRNITEKKLT
E. fergusonii              AQVQLGEIYY YGLGVERDYV QAWAWFDTAS TNDMNLFGTE NRNITEKKLT
Consensus                  AQVQLGEIYY YGLGVERDYV QAWAWFDTAS TNDMNLFGTE NRNITEKKLT
                                                     SEQ ID NO: 663
B-Cell Ep.                                              *          ***** strain CFT073 and 83972    AKQLQQAELL SQQYIEKYAP EAWARMQKLK AQSAVKTGNK
strain ED1a                TKQLQQAELL SQQYIEKYAT EAWARMQKLK AQSAVKTGNK
E. fergusonii              AKQLQQAELL SQQYIEKYAP EAWARMQKLN ARSTVTTGNK
Consensus                   KQLQQAELL SQQYIEKYA  EAWARMQKL  A+S V TGNK
                           SEQ ID NO: 664
B-Cell Epitopes SEQ ID NO: 665             FQGNETTKDLT
SEQ ID NO: 666             AEQGYTPA
SEQ ID NO: 667             GEGVP(K/Q)DYA
SEQ ID NO: 668             LPQAQQ
SEQ ID NO: 669             EQGRDSGQQSMGDAYFEGDGVT
SEQ ID NO: 670             SKAAEQGNV
SEQ ID NO: 671             YRKSATSGDEL
SEQ ID NO: 672             TQDYT
SEQ ID NO: 673             LAGAKEPL
SEQ ID NO: 674             GVKKDEQQ
SEQ ID NO: 675             TASTN
SEQ ID NO: 676             NRNIT
```

Specific Polypeptides Used with the Invention

An aspect of the invention includes an isolated or recombinant polypeptide comprising an *E. coli* protein selected from the group consisting of orf353, bacterial Ig-like domain (group 1) protein (orf405), flu antigen 43 (orf1364), NodT-family outer-membrane-factor-lipoprotein efflux transporter (orf1767), gspK (orf3515), gspJ (orf3516), tonB-dependent siderophore receptor (orf3597), fibrial protein (orf3613), upec-948, upec-1232, A chain precursor of the type-1 fimbrial protein (upec-1875), yapH homolog (upec-2820), and hemolysin A (recp-3768).

In certain embodiments, the isolated or recombinant polypeptide may have an amino acid sequence having at least a % identity to SEQ ID NOs: 1-105.

In certain embodiments, the polypeptide comprises an amino acid that when aligned with any of SEQ ID NOs: 1-105 using a pairwise alignment algorithm, each moving window of x amino acids from N terminus to C terminus has at least x·y identical aligned amino acids, where: x is selected from 20, 25, 30, 35, 40, 45, 50, 60, 70, 80, 90, 100, 150, 200; y is selected from 0.50, 0.60, 0.70, 0.75, 0.80, 0.85, 0.90, 0.91, 0.92, 0.93, 0.94, 0.95, 0.96, 0.97, 0.98, 0.99; and if x·y is not an integer then it is rounded up to the nearest integer.

In certain embodiments, the isolated or recombinant polypeptide will include at least b consecutive amino acids of any of SEQ ID NOs: 1-105, wherein the at least b consecutive amino acids is immunogenic.

In certain embodiments where the isolated or recombinant polypeptide is orf353, the isolated or recombinant polypeptide will comprise less than 160, less than 150, less than 140 or less than 130 amino acids from SEQ ID NOs: 1-2. Preferred examples will include SEQ ID NOs: 211-218.

In certain embodiments where the isolated or recombinant polypeptide is bacterial Ig-like domain (group 1) protein (orf405), the isolated or recombinant polypeptide will comprise less than 1410, less than 1400, less than 1390 or less than 1380 amino acids from SEQ ID NOs: 3-18. Preferred examples will include SEQ ID NOs: 219-307 & 683.

In certain embodiments where the isolated or recombinant polypeptide is flu antigen 43 (orf1364), the isolated or recombinant polypeptide will comprise less than 1040, less than 1030, less than 1020 or less than 1010 amino acids from SEQ ID NOs: 19-40. Preferred examples will include SEQ ID NOs: 308-350.

In certain embodiments where the isolated or recombinant polypeptide is NodT-family outer-membrane-factor-lipoprotein efflux transporter (orf1767), the isolated or recombinant polypeptide will comprise less than 450, less than 440, less than 430 or less than 420 amino acids from SEQ ID NOs: 41-47. Preferred examples will include SEQ ID NOs: 351-368.

In certain embodiments where the isolated or recombinant polypeptide is gspK (orf3515), the isolated or recombinant polypeptide will comprise less than 320, less than 310, less than 300 or less than 290 amino acids from SEQ ID NOs: 48-60. Preferred examples will include SEQ ID NOs: 369-384.

In certain embodiments where the isolated or recombinant polypeptide is gspJ (orf3516), the isolated or recombinant polypeptide will comprise less than 180, less than 170, less than 160 or less than 150 amino acids from SEQ ID NOs: 61-71. Preferred examples will include SEQ ID NOs: 385-398.

In certain embodiments where the isolated or recombinant polypeptide is tonB-dependent siderophore receptor (orf3597), the isolated or recombinant polypeptide will comprise less than 710, less than 700, less than 690 or less than 680 amino acids from SEQ ID NOs: 72-79. Preferred examples will include SEQ ID NOs: 399-425.

In certain embodiments where the isolated or recombinant polypeptide is fibrial protein (orf3613), the isolated or recombinant polypeptide will comprise less than 180, less than 170, less than 160 or less than 150 amino acids from SEQ ID NOs: 80-81. Preferred examples will include SEQ ID NO: 426-432.

In certain embodiments where the isolated or recombinant polypeptide is upec-948, the isolated or recombinant polypeptide will comprise less than 150, less than 140, less than 130 or less than 120 amino acids from SEQ ID NOs: 82-84. Preferred examples will include SEQ ID NOs: 493-499.

In certain embodiments where the isolated or recombinant polypeptide is upec-1232, the isolated or recombinant polypeptide will comprise less than 150, less than 140, less than 130 or less than 120 amino acids from SEQ ID NOs: 85-91. Preferred examples will include SEQ ID NOs: 500-506.

In certain embodiments where the isolated or recombinant polypeptide is A chain precursor of the type-1 fimbrial protein (upec-1875), the isolated or recombinant polypeptide will comprise less than 180, less than 170, less than 160 or less than 150 amino acids from SEQ ID NOs: 92-98. Preferred examples will include SEQ ID NOs: 507-515.

In certain embodiments where the isolated or recombinant polypeptide is yapH homolog (upec-2820), the isolated or recombinant polypeptide will comprise less than 2640, less than 2620, less than 2600 or less than 2580 amino acids from SEQ ID NOs: 99-100. Preferred examples will include SEQ ID NOs: 516-638.

In certain embodiments where the isolated or recombinant polypeptide is hemolysin A (recp-3768), the isolated or recombinant polypeptide will comprise less than 1020, less than 1010, less than 1000 or less than 990 amino acids from SEQ ID NOs: 101-105. Preferred examples will include SEQ ID NOs: 433-492. In certain embodiments, the isolated or recombinant polypeptide includes a fragment of an *E. coli* hemolysin A (recp-3768) wherein the fragment contains a deletion relative to the *E. coli* AcfD protein which increases solubility of the fragment as compared to the full length protein and wherein the fragment raises a substantially similar immune response in a subject as the *E. coli* AcfD protein.

In certain embodiments which may be combined with any of the preceding embodiments, the polypeptide does not comprise the corresponding full length protein (e.g., orf353, bacterial Ig-like domain (group 1) protein (orf405), flu antigen 43 (orf1364), NodT-family outer-membrane-factor-lipoprotein efflux transporter (orf1767), gspK (orf3515), gspJ (orf3516), tonB-dependent siderophore receptor (orf3597), fibrial protein (orf3613), upec-948, upec-1232, A chain precursor of the type-1 fimbrial protein (upec-1875), yapH homolog (upec-2820), and hemolysin A (recp-3768)). Examples of such corresponding full length proteins include SEQ ID NOs: 1-105.

An aspect of the invention includes an isolated or recombinant polypeptide comprising an *Escherichia* Sel1 repeat-containing protein (upec-5211).

In certain embodiments, the isolated or recombinant polypeptide may have an amino acid sequence having at least a % identity to SEQ ID NOs: 653-655.

In certain embodiments, the polypeptide comprises an amino acid that when aligned with any of SEQ ID NOs: 653-655 using a pairwise alignment algorithm, each moving window of x amino acids from N terminus to C terminus has at least x·y identical aligned amino acids, where: x is selected from 20, 25, 30, 35, 40, 45, 50, 60, 70, 80, 90, 100, 150, 200; y is selected from 0.50, 0.60, 0.70, 0.75, 0.80, 0.85, 0.90, 0.91, 0.92, 0.93, 0.94, 0.95, 0.96, 0.97, 0.98, 0.99; and if x·y is not an integer then it is rounded up to the nearest integer.

In certain embodiments, the isolated or recombinant polypeptide will include at least b consecutive amino acids of any of SEQ ID NOs: 653-655, wherein the at least b consecutive amino acids is immunogenic.

In certain embodiments, the isolated or recombinant polypeptide will comprise less than 480, less than 470, less than 460, less than 450, less than 425, less than 400, less than 350, less than 200, or less than 250 amino acids from SEQ ID NOs: 653-655. Preferred examples will include SEQ ID NOs: 656-676.

Any of the polypeptides disclosed herein have utility as components of vaccines. Thus in another embodiment, the isolated or recombinant polypeptide will be with an adjuvant.

Another aspect of the invention includes a polynucleotide encoding any of the foregoing polypeptides. In certain embodiments, the polynucleotide has at a % sequence identity to a nucleic acid sequence selected from the group consisting of SEQ ID NOs:106-210.

Another aspect of the invention includes an immunogenic polypeptide which includes a fragment of an orf405 protein wherein the fragment contains a deletion relative to the *E. coli* orf405 which increases solubility of the fragment as compared to the full length protein and wherein the fragment raises a substantially similar immune response in a subject as the *E. coli* orf405. One example of such is SEQ ID NO:642. In certain embodiments, the fragment of an orf405 protein has less than 1200 amino acids, less than 1100 amino acids, less than 1000 amino acids, less than 950 amino acids, less than 900 amino acids, less than 850 amino acids, less than 800 amino acids, less than 750 amino acids, less than 700 amino acids, less than 650 amino acids, less than 600 amino acids, less than 590 amino acids, or less than 580 amino acids of the orf405 protein.

In certain embodiments with may be combined with any of the foregoing embodiments, the fragment of orf405 with increased solubility has (a) the amino acid sequence selected from the group consisting of SEQ ID NOs 3-18; (b) from 1 to 10 single amino acid alterations compared to SEQ ID NOs: 3-18; at least a % sequence identity to any one of SEQ ID NOs: 3-18; and/or (d) when aligned with any of SEQ ID NOs: 3-18 using a pairwise alignment algorithm, each moving window of x amino acids from N terminus to C terminus has at least x·y identical aligned amino acids, where: x is selected from 20, 25, 30, 35, 40, 45, 50, 60, 70, 80, 90, 100, 150, 200; y is selected from 0.50, 0.60, 0.70, 0.75, 0.80, 0.85, 0.90, 0.91, 0.92, 0.93, 0.94, 0.95, 0.96, 0.97, 0.98, 0.99; and if x·y is not an integer then it is rounded up to the nearest integer. In certain embodiments with may be combined with any of the foregoing embodiments, the fragment of orf405 with increased solubility is isolated, purified, or recombinant. In certain embodiments with may be combined with any of the foregoing embodiments, the immunogenic polypeptide may be combined with an adjuvant.

Another aspect of the invention includes an immunogenic polypeptide comprising a fragment of a flu antigen 43 (orf1364) protein wherein the fragment contains a deletion relative to the *E. coli* flu antigen 43 (orf1364) which increases solubility of the fragment as compared to the full length protein and wherein the fragment raises a substantially similar immune response in a subject as the *E. coli* flu antigen 43 (orf1364). One example of such is SEQ ID NO:652. In certain embodiments, the *E. coli* flu antigen 43 has less than 950 amino acids, less than 900 amino acids, less than 850 amino acids, less than 800 amino acids, less than 750 amino acids, less than 700 amino acids, less than 650 amino acids, less than 600 amino acids, less than 550 amino acids, less than 500 amino acids, less than 450 amino acids, less than 440 amino acids, or less than 430 amino acids of the flu antigen 43 (orf1364) protein. In certain embodiments with may be combined with any of the foregoing embodiments, the fragment of flu antigen 43 (orf1364) with increased solubility has (a) the amino acid sequence selected from the group consisting of SEQ ID NOs 19-40; (b) from 1 to 10 single amino acid alterations compared to SEQ ID NOs: 19-40; (c) at least a % sequence identity to any one of SEQ ID NOs: 19-40; and/or (d) when aligned with any of SEQ ID NOs: 19-40 using a pairwise alignment algorithm, each moving window of x amino acids from N terminus to C terminus has at least x·y identical aligned amino acids, where: x is selected from 20, 25, 30, 35, 40, 45, 50, 60, 70, 80, 90, 100, 150, 200; y is selected from 0.50, 0.60, 0.70, 0.75, 0.80, 0.85, 0.90, 0.91, 0.92, 0.93, 0.94, 0.95, 0.96, 0.97, 0.98, 0.99; and if x·y is not an integer then it is rounded up to the nearest integer. In certain embodiments with may be combined with any of the foregoing embodiments, the fragment of flu antigen 43 (orf1364) with increased solubility is isolated, purified, or recombinant. In certain embodiments with may be combined with any of the foregoing embodiments, the immunogenic polypeptide may be combined with an adjuvant.

Another aspect of the invention includes an immunogenic polypeptide comprising a fragment of an yapH homolog (upec-2820) protein wherein the fragment contains a deletion relative to the *E. coli* yapH homolog (upec-2820) which increases solubility of the fragment as compared to the full length protein and wherein the fragment raises a substantially similar immune response in a subject as the *E. coli* yapH homolog (upec-2820). Examples of such are SEQ ID NO:644, SEQ ID NO:646, SEQ ID NO: 648, or SEQ ID NO: 650. In certain embodiments, the fragment of an *E. coli* yapH homolog has less than 2500 amino acids, less than 2000 amino acids, less than 1750 amino acids, less than 1500 amino acids, less than 1400 amino acids, less than 1300 amino acids, less than 1200 amino acids, less than 1100 amino acids, less than 1000 amino acids, less than 900 amino acids, less than 850 amino acids, less than 800 amino acids, less than 750 amino acids, less than 700 amino acids, less than 650 amino acids, less than 600 amino acids, less than 550 amino acids, less than 500 amino acids, less than 450 amino acids, less than 400 amino acids, or less than 390 amino acids of the yapH homolog (upec-2820) protein. In certain embodiments with may be combined with any of the foregoing embodiments, the fragment of yapH homolog (upec-2820) with increased solubility has (a) the amino acid sequence selected from the group consisting of SEQ ID NOs 99-100; (b) from 1 to 10 single amino acid alterations compared to SEQ ID NOs: 99-100; (c) at least a % sequence identity to any one of SEQ ID NOs: 99-100; and/or (d) when aligned with any of SEQ ID NOs: 99-100 using a pairwise alignment algorithm, each moving window of x amino acids from N terminus to C terminus has at least x·y identical aligned amino acids, where: x is selected from 20, 25, 30, 35, 40, 45, 50, 60, 70, 80, 90, 100, 150, 200; y is selected from 0.50, 0.60, 0.70, 0.75, 0.80, 0.85, 0.90, 0.91, 0.92, 0.93, 0.94, 0.95, 0.96, 0.97, 0.98, 0.99; and if x·y is not an integer then it is rounded up to the nearest integer. In certain embodiments with may be combined with any of the foregoing embodiments, the fragment of yapH homolog (upec-2820) with increased solubility is isolated, purified, or recombinant. In certain embodiments with may be combined with any of the foregoing embodiments, the immunogenic polypeptide may be combined with an adjuvant.

Another aspect of the invention includes an immunogenic polypeptide comprising a fragment of an hemolysin A (recp3768) protein wherein the fragment contains a deletion relative to the E. coli hemolysin A (recp3768) which increases solubility of the fragment as compared to the full length protein and wherein the fragment raises a substantially similar immune response in a subject as the E. coli hemolysin A (recp3768). One example of such is SEQ ID NO:640. In certain embodiments, the fragment of an E. coli hemolysin A has less than 1000 amino acids, less than 950 amino acids, less than 900 amino acids, less than 850 amino acids, less than 800 amino acids, less than 750 amino acids, less than 700 amino acids, less than 650 amino acids, less than 600 amino acids, less than 550 amino acids, less than 500 amino acids, less than 450 amino acids, less than 400 amino acids, less than 390 amino acids, less than 380 amino acids, less than 350 amino acids, less than 300 amino acids, less than 250 amino acids, less than 240 amino acids, less than 230 amino acids, or less than 220 amino acids of the hemolysin A (recp3768) protein. In certain embodiments with may be combined with any of the foregoing embodiments, the fragment of the hemolysin A (recp3768) with increased solubility has (a) the amino acid sequence selected from the group consisting of SEQ ID NOs 101-105; (b) from 1 to 10 single amino acid alterations compared to SEQ ID NOs: 101-105; (c) at least a % sequence identity to any one of SEQ ID NOs: 101-105; and/or (d) when aligned with any of SEQ ID NOs: 101-105 using a pairwise alignment algorithm, each moving window of x amino acids from N terminus to C terminus has at least x·y identical aligned amino acids, where: x is selected from 20, 25, 30, 35, 40, 45, 50, 60, 70, 80, 90, 100, 150, 200; y is selected from 0.50, 0.60, 0.70, 0.75, 0.80, 0.85, 0.90, 0.91, 0.92, 0.93, 0.94, 0.95, 0.96, 0.97, 0.98, 0.99; and if x·y is not an integer then it is rounded up to the nearest integer. In certain embodiments with may be combined with any of the foregoing embodiments, the fragment of hemolysin A (recp3768) with increased solubility is isolated, purified, or recombinant. In certain embodiments with may be combined with any of the foregoing embodiments, the immunogenic polypeptide may be combined with an adjuvant.

The preferred pairwise alignment algorithm for determining percent identity is the Needleman-Wunsch global alignment algorithm [7], using default parameters (e.g. with Gap opening penalty=10.0, and with Gap extension penalty=0.5, using the EBLOSUM62 scoring matrix). This algorithm is conveniently implemented in the needle tool in the EMBOSS package [8].

These polypeptides include variants of SEQ ID NOs 1 to 105, including allelic variants, polymorphic forms, homologs, orthologs, paralogs, mutants, etc., as well as variants of SEQ ID NOs 653 to 655.

The value of a may be selected from 50%, 60%, 65%, 70%, 75%, 80%, 85%, 87.5%, 90%, 91%, 92%, 93%, 94%, 95%, 96%, 97%, 98%, 99%, 99.5% or more.

The value of b may be selected from 7, 8, 9, 10, 12, 14, 16, 18, 20, 25, 30, 35, 40, 50, 60, 70, 80, 90, 100, 150, 200, 250 or more. Preferred fragments of comprise an epitope or immunogenic fragment from SEQ ID NOs 1 to 105, as well as an epitope or immunogenic fragment from SEQ ID NOs 653 to 655. Other preferred fragments lack one or more amino acids (e.g. 1, 2, 3, 4, 5, 6, 7, 8, 9, 10, 15, 20, 25 or more) from the C-terminus and/or one or more amino acids (e.g. 1, 2, 3, 4, 5, 6, 7, 8, 9, 10, 15, 20, 25 or more) from the N-terminus of SEQ ID NOs 1 to 105, preferably while retaining at least one epitope or immunogenic fragment of SEQ ID NOs 1 to 105, or from the N-terminus of SEQ ID NOs 653 to 655, preferably while retaining at least one epitope or immunogenic fragment of SEQ ID NOs 653 to 655. Other fragments omit one or more protein domains e.g. omission of a signal peptide, of a cytoplasmic domain, of a transmembrane domain, of an extracellular domain, etc. The hemolysin A (recp3768) fragment (B4) was obtained by deleting the amino-terminal hydrophobic domain required for membrane insertion and pore formation (the hydrophobic α-helix region), carboxyl-terminal signal sequence and domains required for pore-forming activity after post-translational acylation. The soluble fragment obtained is a carboxyl-terminal β-sheet and glycine-rich region required for binding to calcium. The flu antigen 43 (orf1364) fragment was obtained by deleting the carboxyl-terminal β-barrel domain while retaining the passenger domain (amino acids 53-620). The orf405 fragment was obtained by deletion of a putative amino-terminal translocator domain while retaining four predicted immunoglobulin-binding-like domains (amino acids 595-1008).

An epitope within a fragment may be a B-cell epitope and/or a T-cell epitope. Such epitopes can be identified empirically (e.g. using PEPSCAN [9, 10] or similar methods), or they can be predicted (e.g. using the Jameson-Wolf antigenic index [11], matrix-based approaches [12], MAPITOPE [13], TEPITOPE [14,15], neural networks [16], OptiMer & EpiMer [17, 18], ADEPT [19], Tsites [20], hydrophilicity [21], antigenic index [22] or the methods disclosed in references 23-24, etc.). Epitopes are the parts of an antigen that are recognised by and bind to the antigen binding sites of antibodies or T-cell receptors, and they may also be referred to as "antigenic determinants".

Immunogenic fragments of SEQ ID NOs 1 to 105 or of SEQ ID NOs 653 to 655 discussed above include, without limitation, immunogenic fragments that, when administered to a subject in a suitable composition which can include an adjuvant (including without limitation any of the adjuvants listed or discussed in the section "Immunogenic compositions and medicaments" below), or a suitable carrier coupled to the polypeptide, induces an antibody or T-cell mediated immune response that recognizes the isolated full length polypeptide SEQ ID NOs 1 to 105 or of SEQ ID NOs 653 to 655, respectively, from which the immunogenic fragment is derived.

A polypeptide of the invention may, compared to any one of SEQ ID NOs 1 to 105 or of SEQ ID NOs 653 to 655, include one or more (e.g. 1, 2, 3, 4, 5, 6, 7, 8, 9, etc.) amino acid substitutions, such as conservative substitutions (i.e. substitutions of one amino acid with another which has a related side chain). Genetically-encoded amino acids are generally divided into four families: (1) acidic i.e. aspartate, glutamate; (2) basic i.e. lysine, arginine, histidine; (3) non-polar i.e. alanine, valine, leucine, isoleucine, proline, phenylalanine, methionine, tryptophan; and (4) uncharged polar i.e. glycine, asparagine, glutamine, cysteine, serine, threonine, tyrosine. Phenylalanine, tryptophan, and tyrosine are sometimes classified jointly as aromatic amino acids. In general, substitution of single amino acids within these families does not have a major effect on the biological activity.

A polypeptide may include one or more (e.g. 1, 2, 3, 4, 5, 6, 7, 8, 9, etc.) single amino acid deletions relative to any one of SEQ ID NOs 1 to 105 or of SEQ ID NOs 653 to 655.

Similarly, a polypeptides may include one or more (e.g. 1, 2, 3, 4, 5, 6, 7, 8, 9, etc.) insertions (e.g. each of 1, 2, 3, 4 or 5 amino acids) relative to any one of SEQ ID NOs 1 to 105 or of SEQ ID NOs 653 to 655.

Within group (c), deletions or substitutions may be at the N-terminus and/or C-terminus, or may be between the two termini. Thus a truncation is an example of a deletion. Truncations may involve deletion of up to 40 (or more) amino acids at the N-terminus and/or C-terminus. As mentioned above, for instance, truncation to remove the N-terminus up to the GGGSG sequence can be used.

In general, when a polypeptide of the invention comprises a sequence that is not identical to a complete one of SEQ ID NOs 1 to 105 or of SEQ ID NOs 653 to 655 (e.g. when it comprises a sequence listing with <100% sequence identity thereto, or when it comprises a fragment thereof) it is preferred that the polypeptide can elicit an antibody that recognises a polypeptide consisting of the complete SEQ ID sequence i.e. the antibody binds to one or more of said SEQ ID NOs 1 to 105 or of SEQ ID NOs 653 to 655. Such antibody may bind specifically to SEQ ID NOs 1 to 105 or to SEQ ID NOs 653 to 655, respectively while not binding to other proteins that are not homologs with affinity significantly higher than the antibody's non-specific affinity to human serum albumin as a non-specific binding reference standard.

A polypeptide of the invention may include a metal ion e.g. a metal ion that is coordinated by one or more amino acids in the polypeptide chain. For instance, the polypeptide may include a monovalent, divalent or trivalent metal cation. Divalent cations are typical, such as $Mn^{2+}$, $Fe^{2+}$, $Co^{2+}$, $Ni^{2+}$, $Cu^{2+}$, etc. The divalent cation is preferably $Zn^{2+}$. The ion may be coordinated by a HEAGH or HEVGH amino acid sequence.

Polypeptides used with the invention can take various forms (e.g. native, fusions, glycosylated, non-glycosylated, lipidated, non-lipidated, phosphorylated, non-phosphorylated, myristoylated, non-myristoylated, monomeric, multimeric, particulate, denatured, etc.). For instance, a polypeptide of the invention may have a lipidated N-terminal cysteine.

Polypeptides used with the invention can be prepared by various means (e.g. recombinant expression, purification from cell culture, chemical synthesis, etc.). Recombinantly-expressed proteins are preferred.

Polypeptides used with the invention are preferably provided in purified or substantially purified form i.e. substantially free from other polypeptides (e.g. free from naturally-occurring polypeptides), particularly from other *E. coli* or host cell polypeptides, and are generally at least about 50% pure (by weight), and usually at least about 90% pure i.e. less than about 50%, and more preferably less than about 10% (e.g. 5%) of a composition is made up of other expressed polypeptides. Thus the antigens in the compositions are separated from the whole organism with which the molecule is expressed.

Polypeptides used with the invention are preferably *E. coli* polypeptides. Such polypeptides may be further selected from NMEC, APEC, UPEC, EAEC, EIEC, EPEC and ETEC *E. coli* polypeptides.

The term "polypeptide" refers to amino acid polymers of any length. The polymer may be linear or branched, it may comprise modified amino acids, and it may be interrupted by non-amino acids. The terms also encompass an amino acid polymer that has been modified naturally or by intervention; for example, disulfide bond formation, glycosylation, lipidation, acetylation, phosphorylation, or any other manipulation or modification, such as conjugation with a labeling component. Also included are, for example, polypeptides containing one or more analogs of an amino acid (including, for example, unnatural amino acids, etc.), as well as other modifications known in the art. Polypeptides can occur as single chains or associated chains.

The invention provides polypeptides comprising a sequence —P-Q- or -Q-P—, wherein: —P— is an amino acid sequence as defined above and -Q- is not a sequence as defined above i.e. the invention provides fusion proteins. Where the N-terminus codon of —P— is not ATG, but this codon is not present at the N-terminus of a polypeptide, it will be translated as the standard amino acid for that codon rather than as a Met. Where this codon is at the N-terminus of a polypeptide, however, it will be translated as Met. Examples of -Q- moieties include, but are not limited to, histidine tags (i.e. $His_n$ where n=3, 4, 5, 6, 7, 8, 9, 10 or more), a maltose-binding protein, or glutathione-S-transferase (GST).

The invention also provides an oligomeric protein comprising a polypeptide of the invention. The oligomer may be a dimer, a trimer, a tetramer, etc. The oligomer may be a homo-oligomer or a hetero-oligomer. Polypeptides in the oligomer may be covalently or non-covalently associated.

The invention also provides *E. coli* polypeptides which are fragments of the full length orf405, flu antigen 43 (orf1364), yapH homolog (upec-2820), and hemolysin A (recp3768) (of which SEQ ID NOs: 3-18, SEQ ID NOs: 19-40, SEQ ID NOs: 99-100, and SEQ ID NO 101-105, respectively, are representative examples) which have increased solubility over the full length protein while raising a substantially similar immune response in a subject as that raised by the full length protein. Examples of such immunogenic polypeptide fragments include any of SEQ ID NOs 640, 642, 644, 646, 648, 650 and 652. Increased solubility may be measured by any means available to one of skill in the art. One simple method involves overexpression of the fragment in bacteria and running comparative samples of total bacterial lysate versus bacterial lysate supernatant after centrifugation or samples of bacterial lysate pellet after centrifugation versus samples of bacterial lysate supernatant after centrifugation. One of skill in the art would grow and express such immunogenic polypeptide fragments using standard techniques (e.g., transform BL21(DE3) bacteria with a pET21 expression vector expressing the fragment, grow the bacteria to 0.6 $OD_{600}$ in LB and induce with 1 mM IPTG, and culture for 3 hours after induction), Such samples may be run on SDS PAGE (e.g., 4-12% MOPS) and roughly quantified by scanning the resulting stained gel and measuring the relative size of the bands. The increased solubility as used herein is as determined at 25° C. Such increased solubility can be a 10% increase in soluble polypeptide, a 20% increase in soluble polypeptide, a 30% increase in soluble polypeptide, a 50% increase in soluble polypeptide, a 75% increase in soluble polypeptide, a 100% increase (i.e., two-fold) in soluble polypeptide, a three-fold increase in soluble polypeptide, a four-fold increase in soluble polypeptide, a five-fold increase in soluble polypeptide, a seven-fold increase in soluble polypeptide, or a ten-fold increase in soluble polypeptide.

Comparison of the immune response raised in a subject by the polypeptide with the immune response raised by the full length protein may be carried out use by any means available to one of skill in the art. One simple method as used in the examples below involves immunization of a model subject such as mouse and then challenge with a lethal dose of *E. coli*. For proper comparison, one of skill in the art would naturally select the same adjuvant such as Freund's complete adjuvant. In such a test the immunogenic polypeptide fragments of the present invention will raise a substantially similar immune response in a subject (i.e., will provide substantially the same protection against the lethal challenge) if, for example, the polypeptide provides at least 70% of the protection provided by the full length protein, at least 80% of the protection provided by the full length protein, at least 85% of the protection provided by the full length protein, at least 90% of the protection provided by the full length protein, at least 95% of the protection provided by the full length protein, at least 97% of the protection provided by the full length protein, at least 98% of the protection provided by the full length protein, or at least 99% of the protection provided by the full length protein.

The corresponding protein against which the immunogenic polypeptide fragment would be compared (for both solubility and immune response raised) may be any representative corresponding *E. coli* protein including without limitation SEQ ID NOs 1-105 and SEQ ID NOs 653-655. In preferred embodiments, the protein will be the corresponding full length protein from which the immunogenic polypeptide fragment is obtained.

In some embodiments, the immunogenic polypeptide will contain a deletion relative to the corresponding *E. coli* protein which results in the increased solubility. The deletion may include removal of substantially all of the highly hydrophobic or transmembrane regions of the full length sequences, e.g., the amino terminal pore-forming domain for the hemolysin A (recp3768) protein, the β-barrel domain for the flu antigen 43 (orf1364) protein, and putative translocator domain for the orf405 protein.

The invention also provides a process for producing a polypeptide of the invention, comprising the step of culturing a host cell transformed with nucleic acid of the invention under conditions which induce polypeptide expression. The polypeptide may then be purified e.g. from culture supernatants.

The invention provides an *E. coli* cell, containing a plasmid that encodes a polypeptide of the invention. The chromosome of the *E. coli* cell may include a homolog of the applicable protein (e.g., orf353, bacterial lg-like domain (group 1) protein (orf405), flu antigen 43 (orf1364), NodT-family outer-membrane-factor-lipoprotein efflux transporter (orf1767), gspK (orf3515), gspJ (orf3516), tonB-dependent siderophore receptor (orf3597), fibrial protein (orf3613), upec-948, upec-1232, A chain precursor of the type-1 fimbrial protein (upec-1875), yapH homolog (upec-2820), and hemolysin A (recp-3768)), or such a homolog may be absent, but in both cases the polypeptide of the invention can be expressed from the plasmid. The plasmid may include a gene encoding a marker, etc. These and other details of suitable plasmids are given below.

Although expression of the polypeptides of the invention may take place in an *E. coli* strain, the invention will usually use a heterologous host for expression. The heterologous host may be prokaryotic (e.g. a bacterium) or eukaryotic. Suitable hosts include, but are not limited to, *Bacillus subtilis, Vibrio cholerae, Salmonella typhi, Salmonella typhimurium, Neisseria lactamica, Neisseria cinerea, Mycobacteria* (e.g. *M. tuberculosis*), yeasts, etc.

The invention provides a process for producing a polypeptide of the invention, comprising the step of synthesising at least part of the polypeptide by chemical means.

Any and all of the foregoing proteins, polypeptides, hybrid polypeptides, epitopes and immunogenic fragments may be in any one of a number of forms including, without limitation, recombinant, isolated or substantially purified (from materials co-existing with such proteins, polypeptides, hybrid polypeptides, epitopes and immunogenic fragments in their natural state).

Nucleic Acids

The invention also provides nucleic acid encoding polypeptides and hybrid polypeptides of the invention. It also provides nucleic acid comprising a nucleotide sequence that encodes one or more polypeptides or hybrid polypeptides of the invention.

The invention also provides nucleic acid comprising nucleotide sequences having sequence identity to such nucleotide sequences. Identity between sequences is preferably determined by the Smith-Waterman homology search algorithm as described above. Such nucleic acids include those using alternative codons to encode the same amino acid.

The invention also provides nucleic acid which can hybridize to these nucleic acids. Hybridization reactions can be performed under conditions of different "stringency". Conditions that increase stringency of a hybridization reaction of widely known and published in the art (e.g. page 7.52 of Sambrook et al (2001) *Molecular Cloning: A laboratory Manual*, 3$^{rd}$ edition (Cold Spring Harbor Laboratory Press). Examples of relevant conditions include (in order of increasing stringency): incubation temperatures of 25° C., 37° C., 50° C., 55° C. and 68° C.; buffer concentrations of 10×SSC, 6×SSC, 1×SSC, 0.1×SSC (where SSC is 0.15 M NaCl and 15 mM citrate buffer) and their equivalents using other buffer systems; formamide concentrations of 0%, 25%, 50%, and 75%; incubation times from 5 minutes to 24 hours; 1, 2, or more washing steps; wash incubation times of 1, 2, or 15 minutes; and wash solutions of 6×SSC, 1×SSC, 0.1×SSC, or de-ionized water. Hybridization techniques and their optimization are well known in the art (e.g. see refs 25, 26, Sambrook et al (2001), etc.].

In some embodiments, nucleic acid of the invention hybridizes to a target under low stringency conditions; in other embodiments it hybridizes under intermediate stringency conditions; in preferred embodiments, it hybridizes under high stringency conditions. An exemplary set of low stringency hybridization conditions is 50° C. and 10×SSC. An exemplary set of intermediate stringency hybridization conditions is 55° C. and 1×SSC. An exemplary set of high stringency hybridization conditions is 68° C. and 0.1×SSC.

The invention includes nucleic acid comprising sequences complementary to these sequences (e.g. for antisense or probing, or for use as primers).

Nucleic acids of the invention can be used in hybridisation reactions (e.g. Northern or Southern blots, or in nucleic acid microarrays or 'gene chips') and amplification reactions (e.g. PCR, SDA, SSSR, LCR, TMA, NASBA, etc.) and other nucleic acid techniques.

Nucleic acid according to the invention can take various forms (e.g. single-stranded, double-stranded, vectors, primers, probes, labelled etc.). Nucleic acids of the invention may be circular or branched, but will generally be linear. Unless otherwise specified or required, any embodiment of the invention that utilizes a nucleic acid may utilize both the double-stranded form and each of two complementary single-stranded forms which make up the double-stranded form. Primers and probes are generally single-stranded, as are antisense nucleic acids.

Nucleic acids of the invention are preferably provided in purified or substantially purified form i.e. substantially free from other nucleic acids (e.g. free from naturally-occurring nucleic acids), particularly from other *E. coli* or host cell nucleic acids, generally being at least about 50% pure (by weight), and usually at least about 90% pure. Nucleic acids of the invention are preferably *E. coli* nucleic acids.

Nucleic acids of the invention may be prepared in many ways e.g. by chemical synthesis (e.g. phosphoramidite synthesis of DNA) in whole or in part, by digesting longer nucleic acids using nucleases (e.g. restriction enzymes), by joining shorter nucleic acids or nucleotides (e.g. using ligases or polymerases), from genomic or cDNA libraries, etc.

Nucleic acid of the invention may be attached to a solid support (e.g. a bead, plate, filter, film, slide, microarray support, resin, etc.). Nucleic acid of the invention may be labelled e.g. with a radioactive or fluorescent label, or a biotin label. This is particularly useful where the nucleic acid is to be used in detection techniques e.g. where the nucleic acid is a primer or as a probe.

The term "nucleic acid" includes in general means a polymeric form of nucleotides of any length, which contain deoxyribonucleotides, ribonucleotides, and/or their analogs. It includes DNA, RNA, DNA/RNA hybrids. It also includes DNA or RNA analogs, such as those containing modified backbones (e.g. peptide nucleic acids (PNAs) or phosphorothioates) or modified bases. Thus the invention includes mRNA, tRNA, rRNA, ribozymes, DNA, cDNA, recombinant nucleic acids, branched nucleic acids, plasmids, vectors, probes, primers, etc. Where nucleic acid of the invention takes the form of RNA, it may or may not have a 5' cap.

Nucleic acids of the invention may be part of a vector i.e. part of a nucleic acid construct designed for transduction/transfection of one or more cell types. Vectors may be, for example, "cloning vectors" which are designed for isolation, propagation and replication of inserted nucleotides, "expression vectors" which are designed for expression of a nucleotide sequence in a host cell, "viral vectors" which is designed to result in the production of a recombinant virus or virus-like particle, or "shuttle vectors", which comprise the attributes of more than one type of vector. Preferred vectors are plasmids, as mentioned above. A "host cell" includes an individual cell or cell culture which can be or has been a recipient of exogenous nucleic acid. Host cells include progeny of a single host cell, and the progeny may not necessarily be completely identical (in morphology or in total DNA complement) to the original parent cell due to natural, accidental, or deliberate mutation and/or change. Host cells include cells transfected or infected in vivo or in vitro with nucleic acid of the invention.

Where a nucleic acid is DNA, it will be appreciated that "U" in a RNA sequence will be replaced by "T" in the DNA. Similarly, where a nucleic acid is RNA, it will be appreciated that "T" in a DNA sequence will be replaced by "U" in the RNA.

The term "complement" or "complementary" when used in relation to nucleic acids refers to Watson-Crick base pairing. Thus the complement of C is G, the complement of G is C, the complement of A is T (or U), and the complement of T (or U) is A. It is also possible to use bases such as I (the purine inosine) e.g. to complement pyrimidines (C or T).

Nucleic acids of the invention can be used, for example: to produce polypeptides; as hybridization probes for the detection of nucleic acid in biological samples; to generate additional copies of the nucleic acids; to generate ribozymes or antisense oligonucleotides; as single-stranded DNA primers or probes; or as triple-strand forming oligonucleotides.

The invention provides a process for producing nucleic acid of the invention, wherein the nucleic acid is synthesised in part or in whole using chemical means.

The invention provides vectors comprising nucleotide sequences of the invention (e.g. cloning or expression vectors) and host cells transformed with such vectors.

Nucleic acid amplification according to the invention may be quantitative and/or real-time.

For certain embodiments of the invention, nucleic acids are preferably at least 7 nucleotides in length (e.g. 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 55, 60, 65, 70, 75, 80, 90, 100, 110, 120, 130, 140, 150, 160, 170, 180, 190, 200, 225, 250, 275, 300 nucleotides or longer).

For certain embodiments of the invention, nucleic acids are preferably at most 500 nucleotides in length (e.g. 450, 400, 350, 300, 250, 200, 150, 140, 130, 120, 110, 100, 90, 80, 75, 70, 65, 60, 55, 50, 45, 40, 39, 38, 37, 36, 35, 34, 33, 32, 31, 30, 29, 28, 27, 26, 25, 24, 23, 22, 21, 20, 19, 18, 17, 16, 15 nucleotides or shorter).

Primers and probes of the invention, and other nucleic acids used for hybridization, are preferably between 10 and 30 nucleotides in length (e.g. 10, 11, 12, 13, 14, 15, 16, 17, 18, 19, 20, 21, 22, 23, 24, 25, 26, 27, 28, 29, or 30 nucleotides).

Immunogenic Compositions and Medicaments

Polypeptides of the invention are useful as active ingredients (immunogens) in immunogenic compositions, and such compositions may be useful as vaccines. Vaccines according to the invention may either be prophylactic (i.e. to prevent infection) or therapeutic (i.e. to treat infection), but will typically be prophylactic.

Immunogenic compositions will be pharmaceutically acceptable. They will usually include components in addition to the antigens e.g. they typically include one or more pharmaceutical carrier(s), excipient(s) and/or adjuvant(s). A thorough discussion of carriers and excipients is available in ref. 155. Thorough discussions of vaccine adjuvants are available in refs. 27 and 28.

Compositions will generally be administered to a mammal in aqueous form. Prior to administration, however, the composition may have been in a non-aqueous form. For instance, although some vaccines are manufactured in aqueous form, then filled and distributed and administered also in aqueous form, other vaccines are lyophilised during manufacture and are reconstituted into an aqueous form at the time of use. Thus a composition of the invention may be dried, such as a lyophilised formulation.

The composition may include preservatives such as thiomersal or 2-phenoxyethanol. It is preferred, however, that the vaccine should be substantially free from (i.e. less than 5 µg/ml) mercurial material e.g. thiomersal-free. Vaccines containing no mercury are more preferred. Preservative-free vaccines are particularly preferred.

To improve thermal stability, a composition may include a temperature protective agent.

To control tonicity, it is preferred to include a physiological salt, such as a sodium salt. Sodium chloride (NaCl) is preferred, which may be present at between 1 and 20 mg/ml e.g. about 10±2 mg/ml NaCl. Other salts that may be present include potassium chloride, potassium dihydrogen phosphate, disodium phosphate dehydrate, magnesium chloride, calcium chloride, etc.

Compositions will generally have an osmolality of between 200 mOsm/kg and 400 mOsm/kg, preferably between 240-360 mOsm/kg, and will more preferably fall within the range of 290-310 mOsm/kg.

Compositions may include one or more buffers. Typical buffers include: a phosphate buffer; a Tris buffer; a borate buffer; a succinate buffer; a histidine buffer (particularly with an aluminum hydroxide adjuvant); or a citrate buffer. Buffers will typically be included in the 5-20 mM range.

The pH of a composition will generally be between 5.0 and 8.1, and more typically between 6.0 and 8.0 e.g. 6.5 and 7.5, or between 7.0 and 7.8.

The composition is preferably sterile. The composition is preferably non-pyrogenic e.g. containing <1 EU (endotoxin unit, a standard measure) per dose, and preferably <0.1 EU per dose. The composition is preferably gluten free.

The composition may include material for a single immunisation, or may include material for multiple immunisations (i.e. a 'multidose' kit). The inclusion of a preservative is preferred in multidose arrangements. As an alternative (or in addition) to including a preservative in multidose compositions, the compositions may be contained in a container having an aseptic adaptor for removal of material.

Human vaccines are typically administered in a dosage volume of about 0.5 ml, although a half dose (i.e. about 0.25 ml) may be administered to children.

Immunogenic compositions of the invention may also comprise one or more immunoregulatory agents. Preferably, one or more of the immunoregulatory agents include one or more adjuvants. The adjuvants may include a TH1 adjuvant and/or a TH2 adjuvant, further discussed below.

Adjuvants which may be used in compositions of the invention include, but are not limited to:

A. Mineral-Containing Compositions

Mineral containing compositions suitable for use as adjuvants in the invention include mineral salts, such as aluminium salts and calcium salts (or mixtures thereof). Calcium salts include calcium phosphate (e.g. the "CAP" particles disclosed in ref. 29). Aluminum salts include hydroxides, phosphates, sulfates, etc., with the salts taking any suitable form (e.g. gel, crystalline, amorphous, etc.). Adsorption to these salts is preferred. The mineral containing compositions may also be formulated as a particle of metal salt [30].

The adjuvants known as aluminum hydroxide and aluminum phosphate may be used. These names are conventional, but are used for convenience only, as neither is a precise description of the actual chemical compound which is present (e.g. see chapter 9 of reference 27). The invention can use any of the "hydroxide" or "phosphate" adjuvants that are in general use as adjuvants. The adjuvants known as "aluminium hydroxide" are typically aluminium oxyhydroxide salts, which are usually at least partially crystalline. The adjuvants known as "aluminium phosphate" are typically aluminium hydroxyphosphates, often also containing a small amount of sulfate (i.e. aluminium hydroxyphosphate sulfate). They may be obtained by precipitation, and the reaction conditions and concentrations during precipitation influence the degree of substitution of phosphate for hydroxyl in the salt.

A fibrous morphology (e.g. as seen in transmission electron micrographs) is typical for aluminium hydroxide adjuvants. The pI of aluminium hydroxide adjuvants is typically about 11 i.e. the adjuvant itself has a positive surface charge at physiological pH. Adsorptive capacities of between 1.8-2.6 mg protein per mg $Al^{+++}$ at pH 7.4 have been reported for aluminium hydroxide adjuvants.

Aluminium phosphate adjuvants generally have a $PO_4/Al$ molar ratio between 0.3 and 1.2, preferably between 0.8 and 1.2, and more preferably 0.95±0.1. The aluminium phosphate will generally be amorphous, particularly for hydroxyphosphate salts. A typical adjuvant is amorphous aluminium hydroxyphosphate with $PO_4/Al$ molar ratio between 0.84 and 0.92, included at 0.6 mg $Al^{3+}$/ml. The aluminium phosphate will generally be particulate (e.g. plate-like morphology as seen in transmission electron micrographs). Typical diameters of the particles are in the range 0.5-20 μm (e.g. about 5-10 μm) after any antigen adsorption. Adsorptive capacities of between 0.7-1.5 mg protein per mg $Al^{+++}$ at pH 7.4 have been reported for aluminium phosphate adjuvants.

The point of zero charge (PZC) of aluminium phosphate is inversely related to the degree of substitution of phosphate for hydroxyl, and this degree of substitution can vary depending on reaction conditions and concentration of reactants used for preparing the salt by precipitation. PZC is also altered by changing the concentration of free phosphate ions in solution (more phosphate=more acidic PZC) or by adding a buffer such as a histidine buffer (makes PZC more basic). Aluminium phosphates used according to the invention will generally have a PZC of between 4.0 and 7.0, more preferably between 5.0 and 6.5 e.g. about 5.7.

Suspensions of aluminium salts used to prepare compositions of the invention may contain a buffer (e.g. a phosphate or a histidine or a Tris buffer), but this is not always necessary. The suspensions are preferably sterile and pyrogen-free. A suspension may include free aqueous phosphate ions e.g. present at a concentration between 1.0 and 20 mM, preferably between 5 and 15 mM, and more preferably about 10 mM. The suspensions may also comprise sodium chloride.

The invention can use a mixture of both an aluminium hydroxide and an aluminium phosphate. In this case there may be more aluminium phosphate than hydroxide e.g. a weight ratio of at least 2:1 e.g. ≥5:1, ≥6:1, ≥7:1, ≥8:1, ≥9:1, etc.

The concentration of $Al^{+++}$ in a composition for administration to a patient is preferably less than 10 mg/ml e.g. ≤5 mg/ml, ≤4 mg/ml, ≤3 mg/ml, ≤2 mg/ml, ≤1 mg/ml, etc. A preferred range is between 0.3 and 1 mg/ml. A maximum of 0.85 mg/dose is preferred.

B. Oil Emulsions

Oil emulsion compositions suitable for use as adjuvants in the invention include squalene-water emulsions, such as MF59 [Chapter 10 of ref 27; see also ref. 31] (5% Squalene, 0.5% Tween 80, and 0.5% Span 85, formulated into submicron particles using a microfluidizer). Complete Freund's adjuvant (CFA) and incomplete Freund's adjuvant (IFA) may also be used.

Various oil-in-water emulsion adjuvants are known, and they typically include at least one oil and at least one surfactant, with the oil(s) and surfactant(s) being biodegradable (metabolisable) and biocompatible. The oil droplets in the emulsion are generally less than 5 μm in diameter, and ideally have a sub-micron diameter, with these small sizes being achieved with a microfluidiser to provide stable emulsions. Droplets with a size less than 220 nm are preferred as they can be subjected to filter sterilization.

The emulsion can comprise oils such as those from an animal (such as fish) or vegetable source. Sources for vegetable oils include nuts, seeds and grains. Peanut oil, soybean oil, coconut oil, and olive oil, the most commonly available, exemplify the nut oils. Jojoba oil can be used e.g. obtained from the jojoba bean. Seed oils include safflower oil, cottonseed oil, sunflower seed oil, sesame seed oil and the like. In the grain group, corn oil is the most readily available, but the oil of other cereal grains such as wheat, oats, rye, rice, teff, triticale and the like may also be used. 6-10 carbon fatty acid esters of glycerol and 1,2-propanediol, while not occurring naturally in seed oils, may be prepared by hydrolysis, separation and esterification of the appropriate materials starting from the nut and seed oils. Fats and oils from mammalian milk are metabolizable and may therefore be used in the practice of this invention. The procedures for separation, purification, saponification and other means necessary for obtaining pure oils from animal sources are well known in the art. Most fish contain metabolizable oils which may be readily recovered. For example, cod liver oil, shark liver oils, and whale oil such as spermaceti exemplify several of the fish oils which may be used herein. A number of branched chain oils are synthesized biochemically in 5-carbon isoprene units and are generally referred to as terpenoids. Shark liver oil contains a branched, unsaturated terpenoids known as squalene, 2,6,10,15,19,23-hexamethyl-2,6,10,14,18,22-tetracosahexaene, which is particularly preferred herein. Squalane, the saturated analog to squalene, is also a preferred oil. Fish oils, including squalene and squalane, are readily available from commercial sources or may be obtained by methods known in the art. Other preferred oils are the tocopherols (see below). Mixtures of oils can be used.

Surfactants can be classified by their 'HLB' (hydrophile/lipophile balance). Preferred surfactants of the invention have a HLB of at least 10, preferably at least 15, and more preferably at least 16. The invention can be used with surfactants including, but not limited to: the polyoxyethylene sorbitan esters surfactants (commonly referred to as the Tweens), especially polysorbate 20 and polysorbate 80; copolymers of ethylene oxide (EO), propylene oxide (PO), and/or butylene oxide (BO), sold under the DOWFAX™ tradename, such as linear EO/PO block copolymers; octoxynols, which can vary in the number of repeating ethoxy (oxy-1,2-ethanediyl) groups, with octoxynol-9 (Triton X-100, or t-octylphenoxypolyethoxyethanol) being of particular interest; (octylphenoxy)polyethoxyethanol (IGEPAL CA-630/NP-40); phospholipids such as phosphatidylcholine (lecithin); nonylphenol ethoxylates, such as the Tergitol™ NP series; polyoxyethylene fatty ethers derived from lauryl, cetyl, stearyl and oleyl alcohols (known as Brij surfactants), such as triethyleneglycol monolauryl ether (Brij 30); and sorbitan esters (commonly known as the SPANs), such as sorbitan trioleate (Span 85) and sorbitan monolaurate. Nonionic surfactants are preferred. Preferred surfactants for including in the emulsion are Tween 80 (polyoxyethylene sorbitan monooleate), Span 85 (sorbitan trioleate), lecithin and Triton X-100.

Mixtures of surfactants can be used e.g. Tween 80/Span 85 mixtures. A combination of a polyoxyethylene sorbitan ester such as polyoxyethylene sorbitan monooleate (Tween 80) and an octoxynol such as t-octylphenoxypolyethoxyethanol (Triton X-100) is also suitable. Another useful combination comprises laureth 9 plus a polyoxyethylene sorbitan ester and/or an octoxynol.

Preferred amounts of surfactants (% by weight) are: polyoxyethylene sorbitan esters (such as Tween 80) 0.01 to 1%, in particular about 0.1%; octyl- or nonylphenoxy polyoxyethanols (such as Triton X-100, or other detergents in the Triton series) 0.001 to 0.1%, in particular 0.005 to 0.02%; polyoxyethylene ethers (such as laureth 9) 0.1 to 20%, preferably 0.1 to 10% and in particular 0.1 to 1% or about 0.5%.

Preferred emulsion adjuvants have an average droplets size of ≤1 µm e.g. ≤750 nm, ≤500 nm, ≤400 nm, ≤300 nm, ≤250 nm, ≤220 nm, ≤200 nm, or smaller. These droplet sizes can conveniently be achieved by techniques such as microfluidisation.

Specific oil-in-water emulsion adjuvants useful with the invention include, but are not limited to:

A submicron emulsion of squalene, Tween 80, and Span 85. The composition of the emulsion by volume can be about 5% squalene, about 0.5% polysorbate 80 and about 0.5% Span 85. In weight terms, these ratios become 4.3% squalene, 0.5% polysorbate 80 and 0.48% Span 85. This adjuvant is known as 'MF59' [32-33], as described in more detail in Chapter 10 of ref. 34 and chapter 12 of ref. 35. The MF59 emulsion advantageously includes citrate ions e.g. 10 mM sodium citrate buffer.

An emulsion of squalene, a tocopherol, and Tween 80. The emulsion may include phosphate buffered saline. It may also include Span 85 (e.g. at 1%) and/or lecithin. These emulsions may have from 2 to 10% squalene, from 2 to 10% tocopherol and from 0.3 to 3% Tween 80, and the weight ratio of squalene:tocopherol is preferably ≤1 as this provides a more stable emulsion. Squalene and Tween 80 may be present volume ratio of about 5:2. One such emulsion can be made by dissolving Tween 80 in PBS to give a 2% solution, then mixing 90 ml of this solution with a mixture of (5 g of DL-α-tocopherol and 5 ml squalene), then microfluidising the mixture. The resulting emulsion may have submicron oil droplets e.g. with an average diameter of between 100 and 250 nm, preferably about 180 nm.

An emulsion of squalene, a tocopherol, and a Triton detergent (e.g. Triton X-100). The emulsion may also include a 3d-MPL (see below). The emulsion may contain a phosphate buffer.

An emulsion comprising a polysorbate (e.g. polysorbate 80), a Triton detergent (e.g. Triton X-100) and a tocopherol (e.g. an α-tocopherol succinate). The emulsion may include these three components at a mass ratio of about 75:11:10 (e.g. 750 µg/ml polysorbate 80, 110 µg/ml Triton X-100 and 100 µg/ml α-tocopherol succinate), and these concentrations should include any contribution of these components from antigens. The emulsion may also include squalene. The emulsion may also include a 3d-MPL (see below). The aqueous phase may contain a phosphate buffer.

An emulsion of squalane, polysorbate 80 and poloxamer 401 ("Pluronic™ L121"). The emulsion can be formulated in phosphate buffered saline, pH 7.4. This emulsion is a useful delivery vehicle for muramyl dipeptides, and has been used with threonyl-MDP in the "SAF-1" adjuvant [36] (0.05-1% Thr-MDP, 5% squalane, 2.5% Pluronic L121 and 0.2% polysorbate 80). It can also be used without the Thr-MDP, as in the "AF" adjuvant [37] (5% squalane, 1.25% Pluronic L121 and 0.2% polysorbate 80). Microfluidisation is preferred.

An emulsion comprising squalene, an aqueous solvent, a polyoxyethylene alkyl ether hydrophilic nonionic surfactant (e.g. polyoxyethylene (12) cetostearyl ether) and a hydrophobic nonionic surfactant (e.g. a sorbitan ester or mannide ester, such as sorbitan monoleate or 'Span 80'). The emulsion is preferably thermoreversible and/or has at least 90% of the oil droplets (by volume) with a size less than 200 nm [38]. The emulsion may also include one or more of: alditol; a cryoprotective agent (e.g. a sugar, such as dodecylmaltoside and/or sucrose); and/or an alkylpolyglycoside. Such emulsions may be lyophilized.

An emulsion of squalene, poloxamer 105 and Abil-Care [39]. The final concentration (weight) of these components in adjuvanted vaccines are 5% squalene, 4% poloxamer 105 (pluronic polyol) and 2% Abil-Care 85 (Bis-PEG/PPG-16/16 PEG/PPG-16/16 dimethicone; caprylic/capric triglyceride).

An emulsion having from 0.5-50% of an oil, 0.1-10% of a phospholipid, and 0.05-5% of a non-ionic surfactant. As described in reference 40, preferred phospholipid components are phosphatidylcholine, phosphatidylethanolamine, phosphatidylserine, phosphatidylinositol, phosphatidylglycerol, phosphatidic acid, sphingomyelin and cardiolipin. Submicron droplet sizes are advantageous.

A submicron oil-in-water emulsion of a non-metabolisable oil (such as light mineral oil) and at least one surfactant (such as lecithin, Tween 80 or Span 80). Additives may be included, such as QuilA saponin, cholesterol, a saponin-lipophile conjugate (such as GPI-0100, described in reference 41, produced by addition of aliphatic amine to desacylsaponin via the carboxyl group of glucuronic acid), dimethyldioctadecylammonium bromide and/or N,N-dioctadecyl-N,N-bis(2-hydroxyethyl)propanediamine.

An emulsion in which a saponin (e.g. QuilA or QS21) and a sterol (e.g. a cholesterol) are associated as helical micelles [42].

An emulsion comprising a mineral oil, a non-ionic lipophilic ethoxylated fatty alcohol, and a non-ionic hydrophilic surfactant (e.g. an ethoxylated fatty alcohol and/or polyoxyethylene-polyoxypropylene block copolymer) [43].

An emulsion comprising a mineral oil, a non-ionic hydrophilic ethoxylated fatty alcohol, and a non-ionic lipophilic surfactant (e.g. an ethoxylated fatty alcohol and/or polyoxyethylene-polyoxypropylene block copolymer) [43].

In some embodiments an emulsion may be mixed with antigen extemporaneously, at the time of delivery, and thus the adjuvant and antigen may be kept separately in a packaged or distributed vaccine, ready for final formulation at the time of use. In other embodiments an emulsion is mixed with antigen during manufacture, and thus the composition is packaged in a liquid adjuvanted form. The antigen will generally be in an aqueous form, such that the vaccine is finally prepared by mixing two liquids. The volume ratio of the two liquids for mixing can vary (e.g. between 5:1 and 1:5) but is generally about 1:1. Where concentrations of components are given in the above descriptions of specific emulsions, these concentrations are typically for an undiluted composition, and the concentration after mixing with an antigen solution will thus decrease.

Where a composition includes a tocopherol, any of the α, β, γ, δ, ε or ξ tocopherols can be used, but α-tocopherols are preferred. The tocopherol can take several forms e.g. different salts and/or isomers. Salts include organic salts, such as succinate, acetate, nicotinate, etc. D-α-tocopherol and DL-α-tocopherol can both be used. Tocopherols are advantageously included in vaccines for use in elderly patients (e.g. aged 60 years or older) because vitamin E has been reported to have a positive effect on the immune response in this patient group [44]. They also have antioxidant properties that may help to stabilize the emulsions [45]. A preferred α-tocopherol is DL-α-tocopherol, and the preferred salt of this tocopherol is the succinate. The succinate salt has been found to cooperate with TNF-related ligands in vivo.

C. Saponin Formulations [Chapter 22 of Ref 27]

Saponin formulations may also be used as adjuvants in the invention. Saponins are a heterogeneous group of sterol glycosides and triterpenoid glycosides that are found in the bark, leaves, stems, roots and even flowers of a wide range of plant species. Saponin from the bark of the *Quillaia saponaria* Molina tree have been widely studied as adjuvants. Saponin can also be commercially obtained from *Smilax ornata* (sarsaprilla), *Gypsophilla paniculata* (brides veil), and *Saponaria officianalis* (soap root). Saponin adjuvant formulations include purified formulations, such as QS21, as well as lipid formulations, such as ISCOMs. QS21 is marketed as Stimulon™.

Saponin compositions have been purified using HPLC and RP-HPLC. Specific purified fractions using these techniques have been identified, including QS7, QS17, QS18, QS21, QH-A, QH-B and QH-C. Preferably, the saponin is QS21. A method of production of QS21 is disclosed in ref 46. Saponin formulations may also comprise a sterol, such as cholesterol [47].

Combinations of saponins and cholesterols can be used to form unique particles called immunostimulating complexs (ISCOMs) [chapter 23 of ref. 27]. ISCOMs typically also include a phospholipid such as phosphatidylethanolamine or phosphatidylcholine. Any known saponin can be used in ISCOMs. Preferably, the ISCOM includes one or more of QuilA, QHA & QHC. ISCOMs are further described in refs. 47-48. Optionally, the ISCOMS may be devoid of additional detergent [49].

A review of the development of saponin based adjuvants can be found in refs. 50 & 51.

D. Virosomes and Virus-Like Particles

Virosomes and virus-like particles (VLPs) can also be used as adjuvants in the invention. These structures generally contain one or more proteins from a virus optionally combined or formulated with a phospholipid. They are generally non-pathogenic, non-replicating and generally do not contain any of the native viral genome. The viral proteins may be recombinantly produced or isolated from whole viruses. These viral proteins suitable for use in virosomes or VLPs include proteins derived from influenza virus (such as HA or NA), Hepatitis B virus (such as core or capsid proteins), Hepatitis E virus, measles virus, Sindbis virus, Rotavirus, Foot-and-Mouth Disease virus, Retrovirus, Norwalk virus, human Papilloma virus, HIV, RNA-phages, Qβ-phage (such as coat proteins), GA-phage, fr-phage, AP205 phage, and Ty (such as retrotransposon Ty protein p1). VLPs are discussed further in refs. 52-53. Virosomes are discussed further in, for example, ref. 54

E. Bacterial or Microbial Derivatives

Adjuvants suitable for use in the invention include bacterial or microbial derivatives such as non-toxic derivatives of enterobacterial lipopolysaccharide (LPS), Lipid A derivatives, immunostimulatory oligonucleotides and ADP-ribosylating toxins and detoxified derivatives thereof.

Non-toxic derivatives of LPS include monophosphoryl lipid A (MPL) and 3-O-deacylated MPL (3dMPL). 3dMPL is a mixture of 3 de-O-acylated monophosphoryl lipid A with 4, 5 or 6 acylated chains. A preferred "small particle" form of 3 De-O-acylated monophosphoryl lipid A is disclosed in ref. 55. Such "small particles" of 3dMPL are small enough to be sterile filtered through a 0.22 μm membrane [55]. Other non-toxic LPS derivatives include monophosphoryl lipid A mimics, such as aminoalkyl glucosaminide phosphate derivatives e.g. RC-529 [56, 57].

Lipid A derivatives include derivatives of lipid A from *Escherichia coli* such as OM-174. OM-174 is described for example in refs. 58 & 59.

Immunostimulatory oligonucleotides suitable for use as adjuvants in the invention include nucleotide sequences containing a CpG motif (a dinucleotide sequence containing an unmethylated cytosine linked by a phosphate bond to a guanosine). Double-stranded RNAs and oligonucleotides containing palindromic or poly(dG) sequences have also been shown to be immunostimulatory.

The CpG's can include nucleotide modifications/analogs such as phosphorothioate modifications and can be double-stranded or single-stranded. References 60, 61 and 62 disclose possible analog substitutions e.g. replacement of guanosine with 2'-deoxy-7-deazaguanosine. The adjuvant effect of CpG oligonucleotides is further discussed in refs. 63-64.

The CpG sequence may be directed to TLR9, such as the motif GTCGTT or TTCGTT [65]. The CpG sequence may be specific for inducing a Th1 immune response, such as a CpG-A ODN, or it may be more specific for inducing a B cell response, such a CpG-B ODN. CpG-A and CpG-B ODNs are discussed in refs. 66-67. Preferably, the CpG is a CpG-A ODN.

Preferably, the CpG oligonucleotide is constructed so that the 5' end is accessible for receptor recognition. Optionally, two CpG oligonucleotide sequences may be attached at their 3' ends to form "immunomers". See, for example, refs. 65 & 68-69.

A useful CpG adjuvant is CpG7909, also known as ProMune™ (Coley Pharmaceutical Group, Inc.). Another is CpG1826. As an alternative, or in addition, to using CpG sequences, TpG sequences can be used [70], and these oligonucleotides may be free from unmethylated CpG motifs. The immunostimulatory oligonucleotide may be pyrimidine-rich. For example, it may comprise more than one consecutive thymidine nucleotide (e.g. TTTT, as disclosed in ref. 70), and/or it may have a nucleotide composition with >25% thymidine (e.g. >35%, >40%, >50%, >60%, >80%, etc.). For example, it may comprise more than one consecutive cytosine nucleotide (e.g. CCCC, as disclosed in ref. 70), and/or it may have a nucleotide composition with >25% cytosine (e.g. >35%, >40%, >50%, >60%, >80%, etc.). These oligonucleotides may be free from unmethylated CpG motifs. Immunostimulatory oligonucleotides will typically comprise at least 20 nucleotides. They may comprise fewer than 100 nucleotides.

A particularly useful adjuvant based around immunostimulatory oligonucleotides is known as IC-31™ [71]. Thus an adjuvant used with the invention may comprise a mixture of (i) an oligonucleotide (e.g. between 15-40 nucleotides) including at least one (and preferably multiple) CpI motifs (i.e. a cytosine linked to an inosine to form a dinucleotide), and (ii) a polycationic polymer, such as an oligopeptide (e.g. between 5-20 amino acids) including at least one (and preferably multiple) Lys-Arg-Lys tripeptide sequence(s). The oligonucleotide may be a deoxynucleotide comprising 26-mer sequence 5'-(IC)$_{13}$-3' (SEQ ID NO: 684). The polycationic polymer may be a peptide comprising 11-mer amino acid sequence KLKLLLLLKLK (SEQ ID NO: 685).

Bacterial ADP-ribosylating toxins and detoxified derivatives thereof may be used as adjuvants in the invention. Preferably, the protein is derived from *E. coli* (*E. coli* heat labile enterotoxin "LT"), cholera ("CT"), or pertussis ("PT"). The use of detoxified ADP-ribosylating toxins as mucosal adjuvants is described in ref. 72 and as parenteral adjuvants in ref. 73. The toxin or toxoid is preferably in the form of a holotoxin, comprising both A and B subunits. Preferably, the A subunit contains a detoxifying mutation; preferably the B subunit is not mutated. Preferably, the adjuvant is a detoxified LT mutant such as LT-K63, LT-R72, and LT-G192. The use of ADP-ribosylating toxins and detoxified derivatives thereof, particularly LT-K63 and LT-R72, as adjuvants can be found in refs. 74-75. A useful CT mutant is or CT-E29H [76]. Numerical reference for amino acid substitutions is preferably based on the alignments of the A and B subunits of ADP-ribosylating toxins set forth in ref. 77, specifically incorporated herein by reference in its entirety solely for the purpose of the alignment and amino acid numbering therein.

F. Human Immunomodulators

Human immunomodulators suitable for use as adjuvants in the invention include cytokines, such as interleukins (e.g. IL-1, IL-2, IL-4, IL-5, IL-6, IL-7, IL-12 [78], etc.) [79], interferons (e.g. interferon-γ), macrophage colony stimulating factor, and tumor necrosis factor. A preferred immunomodulator is IL-12.

G. Bioadhesives and Mucoadhesives

Bioadhesives and mucoadhesives may also be used as adjuvants in the invention. Suitable bioadhesives include esterified hyaluronic acid microspheres [80] or mucoadhesives such as cross-linked derivatives of poly(acrylic acid), polyvinyl alcohol, polyvinyl pyrollidone, polysaccharides and carboxymethylcellulose. Chitosan and derivatives thereof may also be used as adjuvants in the invention [81].

H. Microparticles

Microparticles may also be used as adjuvants in the invention. Microparticles (i.e. a particle of ~100 nm to ~150 μm in diameter, more preferably ~200 nm to ~30 μm in diameter, and most preferably ~500 nm to ~10 μm in diameter) formed from materials that are biodegradable and non-toxic (e.g. a poly(α-hydroxy acid), a polyhydroxybutyric acid, a polyorthoester, a polyanhydride, a polycaprolactone, etc.), with poly(lactide-co-glycolide) are preferred, optionally treated to have a negatively-charged surface (e.g. with SDS) or a positively-charged surface (e.g. with a cationic detergent, such as CTAB).

I. Liposomes (Chapters 13 & 14 of Ref 27)

Examples of liposome formulations suitable for use as adjuvants are described in refs. 82-83.

J. Polyoxyethylene Ether and Polyoxyethylene Ester Formulations

Adjuvants suitable for use in the invention include polyoxyethylene ethers and polyoxyethylene esters [84]. Such formulations further include polyoxyethylene sorbitan ester surfactants in combination with an octoxynol [85] as well as polyoxyethylene alkyl ethers or ester surfactants in combination with at least one additional non-ionic surfactant such as an octoxynol [86]. Preferred polyoxyethylene ethers are selected from the following group: polyoxyethylene-9-lauryl ether (laureth 9), polyoxyethylene-9-steoryl ether, polyoxyethylene-8-steoryl ether, polyoxyethylene-4-lauryl ether, polyoxyethylene-35-lauryl ether, and polyoxyethylene-23-lauryl ether.

K. Phosphazenes

A phosphazene, such as poly[di(carboxylatophenoxy) phosphazene] ("PCPP") as described, for example, in references 87 and 88, may be used.

L. Muramyl Peptides

Examples of muramyl peptides suitable for use as adjuvants in the invention include N-acetyl-muramyl-L-threonyl-D-isoglutamine (thr-MDP), N-acetyl-normuramyl-L-alanyl-D-isoglutamine (nor-MDP), and N-acetylmuramyl-L-alanyl-D-isoglutaminyl-L-alanine-2-(1'-2'-dipalmitoyl-sn-glycero-3-hydroxyphosphoryloxy)-ethylamine MTP-PE).

M. Imidazoquinolone Compounds.

Examples of imidazoquinolone compounds suitable for use adjuvants in the invention include Imiquimod ("R-837") [89,90], Resiquimod ("R-848") [91], and their analogs; and salts thereof (e.g. the hydrochloride salts). Further details about immunostimulatory imidazoquinolines can be found in references 92 to 93.

N. Substituted ureas Substituted ureas useful as adjuvants include compounds of formula I, II or III, or salts thereof:

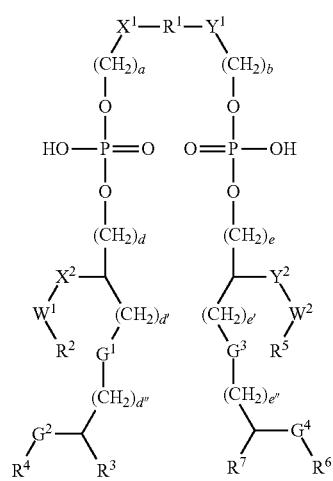

I

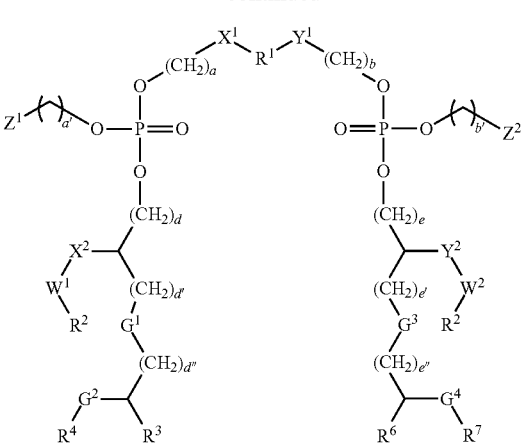

II

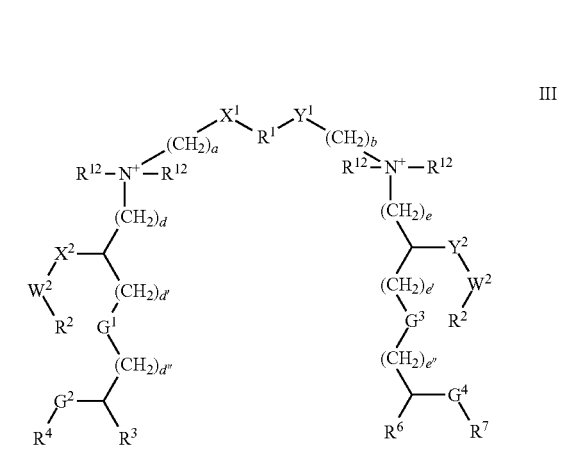

III as defined in reference i, such as 'ER 803058', 'ER 803732', 'ER 804053', ER 804058', 'ER 804059', 'ER 804442', 'ER 804680', 'ER 804764', ER 803022 or 'ER 804057' e.g.:

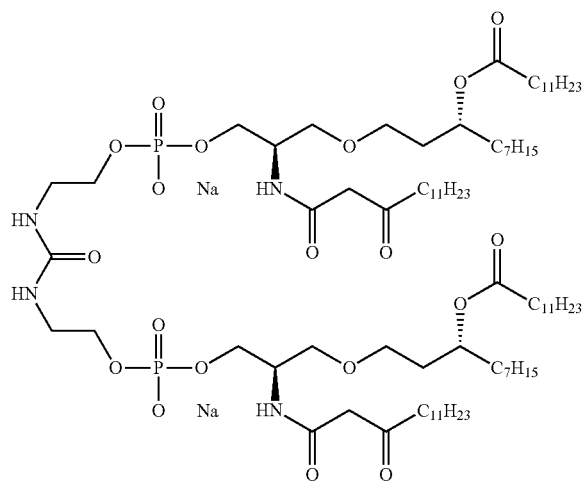

ER804057

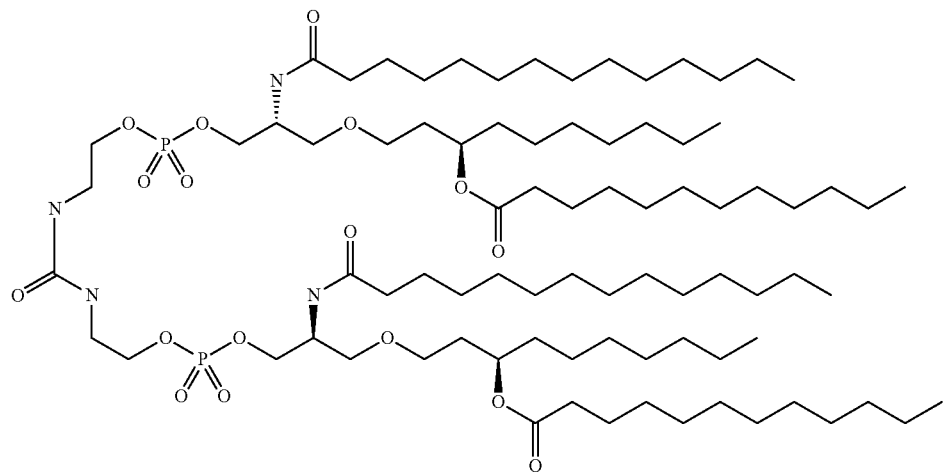
ER-803022

O. Further Adjuvants

Further adjuvants that may be used with the invention include:

- An aminoalkyl glucosaminide phosphate derivative, such as RC-529 [95, 96].
- A thiosemicarbazone compound, such as those disclosed in reference 97. Methods of formulating, manufacturing, and screening for active compounds are also described in reference 97. The thiosemicarbazones are particularly effective in the stimulation of human peripheral blood mononuclear cells for the production of cytokines, such as TNF-α.
- A tryptanthrin compound, such as those disclosed in reference 98. Methods of formulating, manufacturing, and screening for active compounds are also described in reference 98. The thiosemicarbazones are particularly effective in the stimulation of human peripheral blood mononuclear cells for the production of cytokines, such as TNF-α.
- A nucleoside analog, such as: (a) Isatorabine (ANA-245; 7-thia-8-oxoguanosine):

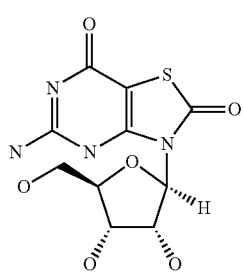 [SMILES: Nc1nc(=O)c2sc(=O)n([C@@H]3O[C@H](CO)[C@@H](O)[C@H]3O)c2[nH]1]

and prodrugs thereof; (b) ANA975; (c) ANA-025-1; (d) ANA380; (e) the compounds disclosed in references 99 to 100 Loxoribine (7-allyl-8-oxoguanosine) [101].
- Compounds disclosed in reference 102, including: Acylpiperazine compounds, Indoledione compounds, Tetrahydraisoquinoline (THIQ) compounds, Benzocyclodione compounds, Aminoazavinyl compounds, Aminobenzimidazole quinolinone (ABIQ) compounds [103, 104], Hydrapthalamide compounds, Benzophenone compounds, Isoxazole compounds, Sterol compounds, Quinazilinone compounds, Pyrrole compounds [105], Anthraquinone compounds, Quinoxaline compounds, Triazine compounds, Pyrazalopyrimidine compounds, and Benzazole compounds [106].
- Compounds containing lipids linked to a phosphate-containing acyclic backbone, such as the TLR4 antagonist E5564 [107, 108]:
- A polyoxidonium polymer [109, 110] or other N-oxidized polyethylene-piperazine derivative.
- Methyl inosine 5'-monophosphate ("MIMP") [111].
- A polyhydroxlated pyrrolizidine compound [112], such as one having formula:

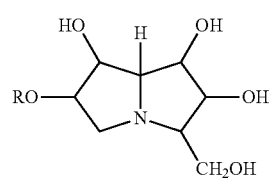

where R is selected from the group comprising hydrogen, straight or branched, unsubstituted or substituted, saturated or unsaturated acyl, alkyl (e.g. cycloalkyl), alkenyl, alkynyl and aryl groups, or a pharmaceutically acceptable salt or derivative thereof. Examples include, but are not limited to: casuarine, casuarine-6-α-D-glucopyranose, 3-epi-casuarine, 7-epi-casuarine, 3,7-diepi-casuarine, etc.
- A CD1d ligand, such as an α-glycosylceramide [113-114] (e.g. α-galactosylceramide), phytosphingosine-containing α-glycosylceramides, OCH, KRN7000 [(2S,3S,4R)-1-O-(α-D-galactopyranosyl)-2-(N-hexacosanoylamino)-1,3,4-octadecanetriol], CRONY-101, 3"-O-sulfo-galactosylceramide, etc.
- A gamma inulin [115] or derivative thereof, such as algammulin.

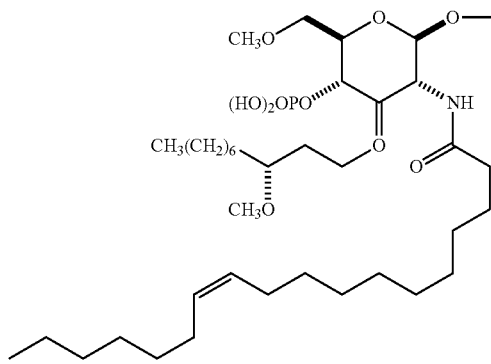
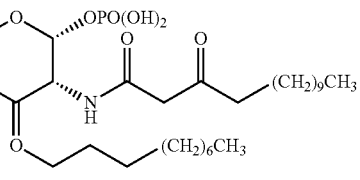

Adjuvant Combinations

The invention may also comprise combinations of aspects of one or more of the adjuvants identified above. For example, the following adjuvant compositions may be used in the invention: (1) a saponin and an oil-in-water emulsion [116]; (2) a saponin (e.g. QS21)+a non-toxic LPS derivative (e.g. 3dMPL) [117]; (3) a saponin (e.g. QS21)+a non-toxic LPS derivative (e.g. 3dMPL)+a cholesterol; (4) a saponin (e.g. QS21)+3dMPL+IL-12 (optionally+a sterol) [118]; (5) combinations of 3dMPL with, for example, QS21 and/or oil-in-water emulsions [119]; (6) SAF, containing 10% squalane, 0.4% Tween 80™, 5% pluronic-block polymer L121, and thr-MDP, either microfluidized into a submicron emulsion or vortexed to generate a larger particle size emulsion. (7) Ribi™ adjuvant system (RAS), (Ribi Immunochem) containing 2% squalene, 0.2% Tween 80, and one or more bacterial cell wall components from the group consisting of monophosphorylipid A (MPL), trehalose dimycolate (TDM), and cell wall skeleton (CWS), preferably MPL+CWS (Detox™); and (8) one or more mineral salts (such as an aluminum salt)+a non-toxic derivative of LPS (such as 3dMPL).

Other substances that act as immunostimulating agents are disclosed in chapter 7 of ref. 27.

The use of an aluminium hydroxide and/or aluminium phosphate adjuvant is particularly preferred, and antigens are generally adsorbed to these salts. Calcium phosphate is another preferred adjuvant. Other preferred adjuvant combinations include combinations of Th1 and Th2 adjuvants such as CpG & alum or resiquimod & alum. A combination of aluminium phosphate and 3dMPL may be used.

The compositions of the invention may elicit both a cell mediated immune response as well as a humoral immune response. This immune response will preferably induce long lasting (e.g. neutralising) antibodies and a cell mediated immunity that can quickly respond upon exposure to pnuemococcus.

Two types of T cells, CD4 and CD8 cells, are generally thought necessary to initiate and/or enhance cell mediated immunity and humoral immunity. CD8 T cells can express a CD8 co-receptor and are commonly referred to as Cytotoxic T lymphocytes (CTLs). CD8 T cells are able to recognized or interact with antigens displayed on MHC Class 1 molecules.

CD4 T cells can express a CD4 co-receptor and are commonly referred to as T helper cells. CD4 T cells are able to recognize antigenic peptides bound to MHC class II molecules. Upon interaction with a MHC class II molecule, the CD4 cells can secrete factors such as cytokines.

These secreted cytokines can activate B cells, cytotoxic T cells, macrophages, and other cells that participate in an immune response. Helper T cells or CD4+ cells can be further divided into two functionally distinct subsets: TH1 phenotype and TH2 phenotypes which differ in their cytokine and effector function.

Activated TH1 cells enhance cellular immunity (including an increase in antigen-specific CTL production) and are therefore of particular value in responding to intracellular infections. Activated TH1 cells may secrete one or more of IL-2, IFN-γ, and TNF-β. A TH1 immune response may result in local inflammatory reactions by activating macrophages, NK (natural killer) cells, and CD8 cytotoxic T cells (CTLs). A TH1 immune response may also act to expand the immune response by stimulating growth of B and T cells with IL-12. TH1 stimulated B cells may secrete IgG2a.

Activated TH2 cells enhance antibody production and are therefore of value in responding to extracellular infections. Activated TH2 cells may secrete one or more of IL-4, IL-5, IL-6, and IL-10. A TH2 immune response may result in the production of IgG1, IgE, IgA and memory B cells for future protection.

An enhanced immune response may include one or more of an enhanced TH1 immune response and a TH2 immune response.

A TH1 immune response may include one or more of an increase in CTLs, an increase in one or more of the cytokines associated with a TH1 immune response (such as IL-2, IFN-γ, and TNF-β), an increase in activated macrophages, an increase in NK activity, or an increase in the production of IgG2a. Preferably, the enhanced TH1 immune response will include an increase in IgG2a production.

A TH1 immune response may be elicited using a TH1 adjuvant. A TH1 adjuvant will generally elicit increased levels of IgG2a production relative to immunization of the antigen without adjuvant. TH1 adjuvants suitable for use in the invention may include for example saponin formulations, virosomes and virus like particles, non-toxic derivatives of enterobacterial lipopolysaccharide (LPS), immunostimulatory oligonucleotides. Immunostimulatory oligonucleotides, such as oligonucleotides containing a CpG motif, are preferred TH1 adjuvants for use in the invention.

A TH2 immune response may include one or more of an increase in one or more of the cytokines associated with a TH2 immune response (such as IL-4, IL-5, IL-6 and IL-10), or an increase in the production of IgG1, IgE, IgA and memory B cells. Preferably, the enhanced TH2 immune response will include an increase in IgG1 production.

A TH2 immune response may be elicited using a TH2 adjuvant. A TH2 adjuvant will generally elicit increased levels of IgG1 production relative to immunization of the antigen without adjuvant. TH2 adjuvants suitable for use in the invention include, for example, mineral containing compositions, oil-emulsions, and ADP-ribosylating toxins and detoxified derivatives thereof. Mineral containing compositions, such as aluminium salts are preferred TH2 adjuvants for use in the invention.

Preferably, the invention includes a composition comprising a combination of a TH1 adjuvant and a TH2 adjuvant. Preferably, such a composition elicits an enhanced TH1 and an enhanced TH2 response, i.e., an increase in the production of both IgG1 and IgG2a production relative to immunization without an adjuvant. Still more preferably, the composition comprising a combination of a TH1 and a TH2 adjuvant elicits an increased TH1 and/or an increased TH2 immune response relative to immunization with a single adjuvant (i.e., relative to immunization with a TH1 adjuvant alone or immunization with a TH2 adjuvant alone).

The immune response may be one or both of a TH1 immune response and a TH2 response. Preferably, immune response provides for one or both of an enhanced TH1 response and an enhanced TH2 response.

The enhanced immune response may be one or both of a systemic and a mucosal immune response. Preferably, the immune response provides for one or both of an enhanced systemic and an enhanced mucosal immune response. Preferably the mucosal immune response is a TH2 immune response. Preferably, the mucosal immune response includes an increase in the production of IgA.

E. coli can cause disease at a number of anatomical locations [4] and so the compositions of the invention may be prepared in various forms. For example, the compositions may be prepared as injectables, either as liquid solutions or suspensions. Solid forms suitable for solution in, or suspension in, liquid vehicles prior to injection can also be prepared (e.g. a lyophilised composition or a spray-freeze dried composition). The composition may be prepared for topical administration e.g. as an ointment, cream or powder. The composition may be prepared for oral administration e.g. as a tablet or capsule, as a spray, or as a syrup (optionally flavoured). The composition may be prepared for pulmonary administration e.g. as an inhaler, using a fine powder or a spray. The composition may be prepared as a suppository or pessary. The composition may be prepared for nasal, aural or ocular administration e.g. as drops. The composition may be in kit form, designed such that a combined composition is reconstituted just prior to administration to a patient. Such kits may comprise one or more antigens in liquid form and one or more lyophilised antigens.

Where a composition is to be prepared extemporaneously prior to use (e.g. where a component is presented in lyophilised form) and is presented as a kit, the kit may comprise two vials, or it may comprise one ready-filled syringe and one vial, with the contents of the syringe being used to reactivate the contents of the vial prior to injection.

Immunogenic compositions used as vaccines comprise an immunologically effective amount of antigen(s), as well as any other components, as needed. By 'immunologically effective amount', it is meant that the administration of that amount to an individual, either in a single dose or as part of a series, is effective for treatment or prevention. This amount varies depending upon the health and physical condition of the individual to be treated, age, the taxonomic group of individual to be treated (e.g. non-human primate, primate, etc.), the capacity of the individual's immune system to synthesise antibodies, the degree of protection desired, the formulation of the vaccine, the treating doctor's assessment of the medical situation, and other relevant factors. It is expected that the amount will fall in a relatively broad range that can be determined through routine trials.

Methods of Treatment, and Administration of the Vaccine

The invention also provides a method for raising an immune response in a mammal comprising the step of administering an effective amount of a composition of the invention. The immune response is preferably protective and preferably involves antibodies and/or cell-mediated immunity. The method may raise a booster response.

The invention also provides a polypeptide of the invention for use as a medicament e.g. for use in raising an immune response in a mammal.

The invention also provides the use of a polypeptide of the invention in the manufacture of a medicament for raising an immune response in a mammal.

The invention also provides a delivery device pre-filled with an immunogenic composition of the invention.

By raising an immune response in the mammal by these uses and methods, the mammal can be protected against E. coli infection, including ExPEC and non-ExPEC strains. The invention is particularly useful for providing broad protection against pathogenic E. coli, including intestinal pathotypes such as EPEC, EAEC, EIEC, ETEC and DAEC pathotypes. Thus the mammal may be protected against diseases including, but not limited to peritonitis, pyelonephritis, cystitis, endocarditis, prostatitis, urinary tract infections (UTIs), meningitis (particularly neonatal meningitis), sepsis (or SIRS), dehydration, pneumonia, diarrhea (infantile, travellers', acute, persistent, etc.), bacillary dysentery, hemolytic uremic syndrome (HUS), pericarditis, bacteriuria, etc.

The mammal is preferably a human, but may be e.g. a cow, a pig, a chicken, a cat or a dog, as E. coli disease is also problematic in these species [4]. Where the vaccine is for prophylactic use, the human is preferably a child (e.g. a toddler or infant) or a teenager; where the vaccine is for therapeutic use, the human is preferably a teenager or an adult. A vaccine intended for children may also be administered to adults e.g. to assess safety, dosage, immunogenicity, etc.

One way of checking efficacy of therapeutic treatment involves monitoring E. coli infection after administration of the compositions of the invention. One way of checking efficacy of prophylactic treatment involves monitoring immune responses, systemically (such as monitoring the level of IgG1 and IgG2a production) and/or mucosally (such as monitoring the level of IgA production), against the antigens in the compositions of the invention after administration of the composition. Typically, antigen-specific serum antibody responses are determined post-immunisation but pre-challenge whereas antigen-specific mucosal antibody responses are determined post-immunisation and post-challenge.

Another way of assessing the immunogenicity of the compositions of the present invention is to express the proteins recombinantly for screening patient sera or mucosal secretions by immunoblot and/or microarrays. A positive reaction between the protein and the patient sample indicates that the patient has mounted an immune response to the protein in question. This method may also be used to identify immunodominant antigens and/or epitopes within antigens.

The efficacy of vaccine compositions can also be determined in vivo by challenging animal models of E. coli infection, e.g., guinea pigs or mice, with the vaccine compositions. A murine model of ExPEC and lethal sepsis is described in reference 120. A cotton rat model is disclosed in ref. 121

Compositions of the invention will generally be administered directly to a patient. Direct delivery may be accomplished by parenteral injection (e.g. subcutaneously, intraperitoneally, intravenously, intramuscularly, or to the interstitial space of a tissue), or mucosally, such as by rectal, oral (e.g. tablet, spray), vaginal, topical, transdermal or transcutaneous, intranasal, ocular, aural, pulmonary or other mucosal administration. Novel direct delivery forms can also include transgenic expression of the polypeptides disclosed herein in foods, e.g., transgenic expression in a potato.

The invention may be used to elicit systemic and/or mucosal immunity, preferably to elicit an enhanced systemic and/or mucosal immunity.

Preferably the enhanced systemic and/or mucosal immunity is reflected in an enhanced TH1 and/or TH2 immune response. Preferably, the enhanced immune response includes an increase in the production of IgG1 and/or IgG2a and/or IgA.

Dosage can be by a single dose schedule or a multiple dose schedule. Multiple doses may be used in a primary immunisation schedule and/or in a booster immunisation schedule. In a multiple dose schedule the various doses may be given by the same or different routes e.g. a parenteral prime and mucosal boost, a mucosal prime and parenteral boost, etc. Multiple doses will typically be administered at least 1 week apart (e.g. about 2 weeks, about 3 weeks, about 4 weeks, about 6 weeks, about 8 weeks, about 10 weeks, about 12 weeks, about 16 weeks, etc.).

Vaccines of the invention may be used to treat both children and adults. Thus a human patient may be less than 1 year old, 1-5 years old, 5-15 years old, 15-55 years old, or at least 55 years old. Preferred patients for receiving the vaccines are the elderly (e.g. ≥50 years old, ≥60 years old, and preferably ≥65 years), the young (e.g. ≤5 years old), hospitalised patients, healthcare workers, armed service and military personnel, pregnant women, the chronically ill, or immunodeficient patients. The vaccines are not suitable solely for these groups, however, and may be used more generally in a population.

Vaccines of the invention are particularly useful for patients who are expecting a surgical operation, or other hospital in-patients. They are also useful in patients who will be catheterized. They are also useful in adolescent females (e.g. aged 11-18) and in patients with chronic urinary tract infections.

Vaccines of the invention may be administered to patients at substantially the same time as (e.g. during the same medical consultation or visit to a healthcare professional or vaccination centre) other vaccines e.g. at substantially the same time as a measles vaccine, a mumps vaccine, a rubella vaccine, a MMR vaccine, a varicella vaccine, a MMRV vaccine, a diphtheria vaccine, a tetanus vaccine, a pertussis vaccine, a DTP vaccine, a conjugated *H. influenzae* type b vaccine, an inactivated poliovirus vaccine, a hepatitis B virus vaccine, a meningococcal conjugate vaccine (such as a tetravalent A-C—W135-Y vaccine), a respiratory syncytial virus vaccine, etc.

Nucleic Acid Immunisation

The immunogenic compositions described above include polypeptide antigens. In all cases, however, the polypeptide antigens can be replaced by nucleic acids (typically DNA) encoding those polypeptides, to give compositions, methods and uses based on nucleic acid immunisation. Nucleic acid immunisation is now a developed field (e.g. see references 122 to 123 etc.).

The nucleic acid encoding the immunogen is expressed in vivo after delivery to a patient and the expressed immunogen then stimulates the immune system. The active ingredient will typically take the form of a nucleic acid vector comprising: (i) a promoter; (ii) a sequence encoding the immunogen, operably linked to the promoter; and optionally (iii) a selectable marker. Preferred vectors may further comprise (iv) an origin of replication; and (v) a transcription terminator downstream of and operably linked to (ii). In general, (i) & (v) will be eukaryotic and (iii) & (iv) will be prokaryotic.

Preferred promoters are viral promoters e.g. from cytomegalovirus (CMV). The vector may also include transcriptional regulatory sequences (e.g. enhancers) in addition to the promoter and which interact functionally with the promoter. Preferred vectors include the immediate-early CMV enhancer/promoter, and more preferred vectors also include CMV intron A. The promoter is operably linked to a downstream sequence encoding an immunogen, such that expression of the immunogen-encoding sequence is under the promoter's control.

Where a marker is used, it preferably functions in a microbial host (e.g. in a prokaryote, in a bacteria, in a yeast). The marker is preferably a prokaryotic selectable marker (e.g. transcribed under the control of a prokaryotic promoter). For convenience, typical markers are antibiotic resistance genes.

The vector of the invention is preferably an autonomously replicating episomal or extrachromosomal vector, such as a plasmid.

The vector of the invention preferably comprises an origin of replication. It is preferred that the origin of replication is active in prokaryotes but not in eukaryotes.

Preferred vectors thus include a prokaryotic marker for selection of the vector, a prokaryotic origin of replication, but a eukaryotic promoter for driving transcription of the immunogen-encoding sequence. The vectors will therefore (a) be amplified and selected in prokaryotic hosts without polypeptide expression, but (b) be expressed in eukaryotic hosts without being amplified. This arrangement is ideal for nucleic acid immunization vectors.

The vector of the invention may comprise a eukaryotic transcriptional terminator sequence downstream of the coding sequence. This can enhance transcription levels. Where the coding sequence does not have its own, the vector of the invention preferably comprises a polyadenylation sequence. A preferred polyadenylation sequence is from bovine growth hormone.

The vector of the invention may comprise a multiple cloning site

In addition to sequences encoding the immunogen and a marker, the vector may comprise a second eukaryotic coding sequence. The vector may also comprise an IRES upstream of said second sequence in order to permit translation of a second eukaryotic polypeptide from the same transcript as the immunogen. Alternatively, the immunogen-coding sequence may be downstream of an IRES.

The vector of the invention may comprise unmethylated CpG motifs e.g. unmethylated DNA sequences which have in common a cytosine preceding a guanosine, flanked by two 5' purines and two 3' pyrimidines. In their unmethylated form these DNA motifs have been demonstrated to be potent stimulators of several types of immune cell.

Vectors may be delivered in a targeted way. Receptor-mediated DNA delivery techniques are described in, for example, references 124 to 125. Therapeutic compositions containing a nucleic acid are administered in a range of about 100 ng to about 200 mg of DNA for local administration in a gene therapy protocol. Concentration ranges of about 500 ng to about 50 mg, about 1 µg to about 2 mg, about 5 µg to about 500 µg, and about 20 µg to about 100 µg of DNA can also be used during a gene therapy protocol. Factors such as method of action (e.g. for enhancing or inhibiting levels of the encoded gene product) and efficacy of transformation and expression are considerations which will affect the dosage required for ultimate efficacy. Where greater expression is desired over a larger area of tissue, larger amounts of vector or the same amounts re-administered in a successive protocol of administrations, or several administrations to different adjacent or close tissue portions may be required to effect a positive therapeutic outcome. In all cases, routine experimentation in clinical trials will determine specific ranges for optimal therapeutic effect.

Vectors can be delivered using gene delivery vehicles. The gene delivery vehicle can be of viral or non-viral origin (see generally references 126 to 127).

Viral-based vectors for delivery of a desired nucleic acid and expression in a desired cell are well known in the art. Exemplary viral-based vehicles include, but are not limited to, recombinant retroviruses (e.g. references 128 to 129), alphavirus-based vectors (e.g. Sindbis virus vectors, Semliki forest virus (ATCC VR-67; ATCC VR-1247), Ross River virus (ATCC VR-373; ATCC VR-1246) and Venezuelan equine encephalitis virus (ATCC VR-923; ATCC VR-1250; ATCC VR 1249; ATCC VR-532); hybrids or chimeras of these viruses may also be used), poxvirus vectors (e.g. vaccinia, fowlpox, canarypox, modified vaccinia Ankara, etc.), adenovirus vectors, and adeno-associated virus (AAV) vectors (e.g. see refs. 130 to 131). Administration of DNA linked to killed adenovirus [132] can also be employed.

Non-viral delivery vehicles and methods can also be employed, including, but not limited to, polycationic condensed DNA linked or unlinked to killed adenovirus alone [e.g. 132], ligand-linked DNA [133], eukaryotic cell delivery vehicles cells [e.g. refs. 134 to 135] and nucleic charge neutralization or fusion with cell membranes. Naked DNA can also be employed. Exemplary naked DNA introduction methods are described in refs. 136 and 137. Liposomes (e.g. immunoliposomes) that can act as gene delivery vehicles are described in refs. 138 to 139. Additional approaches are described in references 140 & 141.

Further non-viral delivery suitable for use includes mechanical delivery systems such as the approach described in ref 141. Moreover, the coding sequence and the product of expression of such can be delivered through deposition of photopolymerized hydrogel materials or use of ionizing radiation [e.g. refs. 142 & 143]. Other conventional methods for gene delivery that can be used for delivery of the coding sequence include, for example, use of hand-held gene transfer particle gun [144] or use of ionizing radiation for activating transferred genes [142 & 143].

Delivery DNA using PLG {poly(lactide-co-glycolide)} microparticles is a particularly preferred method e.g. by adsorption to the microparticles, which are optionally treated to have a negatively-charged surface (e.g. treated with SDS) or a positively-charged surface (e.g. treated with a cationic detergent, such as CTAB).

Antibodies

Antibodies against *E. coli* antigens can be used for passive immunisation [145]. Thus the invention provides an antibody that binds to both orf353 proteins that consist of SEQ ID NOs: 1-2. In certain embodiments, the antibody will bind a fragment of orf353 selected from the group consisting of SEQ ID NOs: 211-218.

The invention also provides an antibody that binds to at least 2 (e.g. to 3, 4, 5, 6, 7, 8, 9, 10, 11, 12, 13, 14, 15, or all 16) of the 16 bacterial Ig-like domain (group 1) proteins (orf405) that consist of SEQ ID NOs: 3-18. In certain embodiments, the antibody will bind a fragment of bacterial Ig-like domain (group 1) protein (orf405) selected from the group consisting of SEQ ID NOs: 219-307 & 683.

The invention also provides an antibody that binds to at least 2 (e.g. to 3, 4, 5, 6, 7, 8, 9, 10, 11, 12, 13, 14, 15, or all 16) of the 22 flu antigen 43 (orf1364) proteins that consist of SEQ ID NOs: 19-40. In certain embodiments, the antibody will bind a fragment of flu antigen 43 (orf1364) selected from the group consisting of SEQ ID NOs: 308-350.

The invention also provides an antibody that binds to at least 2 (e.g. to 3, 4, 5, 6, or all 7) of the 7 NodT-family outer-membrane-factor-lipoprotein efflux transporters (orf1767) that consist of SEQ ID NOs: 41-47. In certain embodiments, the antibody will bind a fragment of NodT-family outer-membrane-factor-lipoprotein efflux transporter (orf1767) selected from the group consisting of SEQ ID NOs: 351-368.

The invention also provides an antibody that binds to at least 2 (e.g. to 3, 4, 5, 6, 7, 8, 9, 10, 11, 12, or all 13) of the 13 gspK proteins (orf3515) that consist of SEQ ID NOs: 48-60. In certain embodiments, the antibody will bind a fragment of gspK (orf3515) selected from the group consisting of SEQ ID NOs: 369-384.

The invention also provides an antibody that binds to at least 2 (e.g. to 3, 4, 5, 6, 7, 8, 9, 10, or all 11) of the 11 gspJ proteins (orf3516) that consist of SEQ ID NOs: 61-71. In certain embodiments, the antibody will bind a fragment of gspJ (orf3516) selected from the group consisting of SEQ ID NOs: 385-398.

The invention also provides an antibody that binds to at least 2 (e.g. to 3, 4, 5, 6, 7, or all 8) of the 8 tonB-dependent siderophore receptors (orf3597) that consist of SEQ ID NOs: 72-79. In certain embodiments, the antibody will bind a fragment of tonB-dependent siderophore receptor (orf3597) selected from the group consisting of SEQ ID NOs: 399-425.

The invention also provides an antibody that binds to both the fibrial proteins (orf3613) that consist of SEQ ID NOs: 80-81. In certain embodiments, the antibody will bind a fragment of a fibrial protein (orf3613) selected from the group consisting of SEQ ID NO: 426-432.

The invention also provides an antibody that binds to at least 2 (or all 3) of the 3 upec-948 proteins that consist of SEQ ID NOs: 82-84. In certain embodiments, the antibody will bind a fragment of upec-948 selected from the group consisting of SEQ ID NOs: 493-499.

The invention also provides an antibody that binds to at least 2 (e.g. to 3, 4, 5, 6, or all 7) of the 7 upec-1232 proteins that consist of SEQ ID NOs: 85-91. In certain embodiments, the antibody will bind a fragment of upec-1232 selected from the group consisting of SEQ ID NOs: 500-506.

The invention also provides an antibody that binds to at least 2 (e.g. to 3, 4, 5, 6, or all 7) of the 7 A chain precursor of the type-1 fimbrial proteins (upec-1875) that consist of SEQ ID NOs: 92-98. In certain embodiments, the antibody will bind a fragment of A chain precursor of the type-1 fimbrial protein (upec-1875) selected from the group consisting of SEQ ID NOs: 507-515.

The invention also provides an antibody that binds to both of the yapH homolog proteins that consist of SEQ ID NOs: 99-100. In certain embodiments, the antibody will bind a fragment of yapH homolog selected from the group consisting of SEQ ID NOs: 516-638.

The invention also provides an antibody that binds to at least 2 (e.g. to 3, 4, or all 5) of the 5 hemolysin A (recp-3768) that consist of SEQ ID NOs: 101-105. In certain embodiments, the antibody will bind a fragment of hemolysin A (recp-3768) selected from the group consisting of SEQ ID NOs: 433-492.

The invention also provides the use of such antibodies in therapy. The invention also provides the use of such antibodies in the manufacture of a medicament. The invention also provides a method for treating a mammal comprising the step of administering an effective amount of a antibody of the invention. As described above for immunogenic compositions, these methods and uses allow a mammal to be protected against E. coli infection.

The term "antibody" includes intact immunoglobulin molecules, as well as fragments thereof which are capable of binding an antigen. These include hybrid (chimeric) antibody molecules [146, 147]; F(ab')2 and F(ab) fragments and Fv molecules; non-covalent heterodimers [148, 149]; single-chain Fv molecules (sFv) [150]; dimeric and trimeric antibody fragment constructs; minibodies [151, 152]; humanized antibody molecules [153-154]; and any functional fragments obtained from such molecules, as well as antibodies obtained through non-conventional processes such as phage display. Preferably, the antibodies are monoclonal antibodies. Methods of obtaining monoclonal antibodies are well known in the art. Humanised or fully-human antibodies are preferred.

General

The practice of the present invention will employ, unless otherwise indicated, conventional methods of chemistry, biochemistry, molecular biology, immunology and pharmacology, within the skill of the art. Such techniques are explained fully in the literature. See, e.g., references 155-156, etc.

The term "comprising" encompasses "including" as well as "consisting" e.g. a composition "comprising" X may consist exclusively of X or may include something additional e.g. X+Y.

The term "about" in relation to a numerical value x means, for example, x±10%.

"GI" numbering is used herein. A GI number, or "GenInfo Identifier", is a series of digits assigned consecutively to each sequence record processed by NCBI when sequences are added to its databases. The GI number bears no resemblance to the accession number of the sequence record. When a sequence is updated (e.g. for correction, or to add more annotation or information) then it receives a new GI number. Thus the sequence associated with a given GI number is never changed.

References to a percentage sequence identity between two amino acid sequences means that, when aligned, that percentage of amino acids are the same in comparing the two sequences. This alignment and the percent homology or sequence identity can be determined using software programs known in the art, for example those described in section 7.7.18 of ref 157. A preferred alignment is determined by the Smith-Waterman homology search algorithm using an affine gap search with a gap open penalty of 12 and a gap extension penalty of 2, BLOSUM matrix of 62. The Smith-Waterman homology search algorithm is disclosed in ref. 158.

One of skill in the art would understand that "isolated" means altered "by the hand of man" from its natural state, i.e., if it occurs in nature, it has been changed or removed from its original environment, or both. For example, a polynucleotide or a polypeptide naturally present in a living organism is not "isolated" when in such living organism, but the same polynucleotide or polypeptide separated from the coexisting materials of its natural state is "isolated," as the term is used in this disclosure. Further, a polynucleotide or polypeptide that is introduced into an organism by transformation, genetic manipulation or by any other recombinant method would be understood to be "isolated" even if it is still present in said organism, which organism may be living or non-living, except where such transformation, genetic manipulation or other recombinant method produces an organism that is otherwise indistinguishable from the naturally occurring organism.

BRIEF DESCRIPTION OF DRAWINGS

FIGS. 1-14 show the amino acid identity for the disclosed E. coli proteins. For all figures, ##=100% identity.

FIG. 1 shows the amino acid identity between pairs of sequences of orf353 FIG. 1 shows the % identity between the orf353 amino acid sequences. The labels are from left-to right and top-to-bottom: IHE3034 (an NMEC strain); RS218 (an NMEC strain); APEC01 (an APEC strain); CFT073 (an UPEC strain); 536 (an UPEC strain); UTI89 (an UPEC strain); F11 (an UPEC strain); 101-1 (an EAEC strain); O42 (an EAEC strain); 53638 (an EIEC strain); B171 (an EPEC strain); E22 (an EPEC strain); E2348/69 (an EPEC strain); E110019 (an EPEC strain); B7A (an ETEC strain); E24377A (an ETEC strain); H10407 (an ETEC strain); and SECEC (an antibiotic resistant strain).

FIG. 2 shows the amino acid identity between pairs of sequences of bacterial lg-like domain (group 1) protein (orf405). The labels are from left-to right and top-to-bottom: HS (a commensal strain); B (a Non-pathogenic strain); 8739 (a Non-pathogenic strain); C (a Non-pathogenic strain); IHE3034 (an NMEC strain); RS218 (an NMEC strain); APEC01 (an APEC strain); CFT073 (an UPEC strain); 536 (an UPEC strain); UTI89 (an UPEC strain); F11 (an UPEC strain); EDL333 (an EHEC strain); Sakai (an EHEC strain); EC508 (an EHEC strain); EC863 (an EHEC strain); EC4024 (an EHEC strain); EC4042 (an EHEC strain); EC4054 (an EHEC strain); EC4076 (an EHEC strain); EC4113 (an EHEC strain); EC4115 (an EHEC strain); EC4196 (an EHEC strain); EC4206 (an EHEC strain); EC4401 (an EHEC strain); EC4486 (an EHEC strain); EC4501 (an EHEC strain); TW14588 (an EHEC strain); 101-1 (an EAEC strain); O42 (an EAEC strain); 13171 (an EPEC strain); E22 (an EPEC strain); E2348/69 (an EPEC strain); E110019 (an EPEC strain); B7A (an ETEC strain); E24377A (an ETEC strain); H10407 (an ETEC strain); and SECEC (an antibiotic resistant strain).

FIG. 3 shows the amino acid identity between pairs of sequences of flu antigen 43 (orf1364). The labels are from left-to right and top-to-bottom: MG1655 (a Non-pathogenic strain); DH10B (a Non-pathogenic strain); HS (a commensal strain); B (a Non-pathogenic strain); 8739 (a Non-pathogenic strain); C (a Non-pathogenic strain); IHE3034 (an NMEC strain); RS218 (an NMEC strain); APEC01 (an APEC strain); CFT073 (an UPEC strain); 536 (an UPEC strain); UTI89 (an UPEC strain); F11 (an UPEC strain); EDL333 (an EHEC strain); Sakai (an EHEC strain); EC508 (an EHEC strain); EC863 (an EHEC strain); EC4024 (an EHEC strain); EC4042 (an EHEC strain); EC4054 (an EHEC strain); EC4076 (an EHEC strain); EC4113 (an EHEC strain); EC4115 (an EHEC strain); EC4196 (an EHEC strain); EC4206 (an EHEC strain); EC4401 (an EHEC strain); EC4486 (an EHEC strain); EC4501 (an EHEC strain); TW14588 (an EHEC strain); 101-1 (an EAEC strain); O42 (an EAEC strain); 53638 (an EIEC strain); B171 (an EPEC strain); E22 (an EPEC strain); E2348/69 (an EPEC strain); E110019 (an EPEC strain); B7A (an ETEC strain); E24377A (an ETEC strain); H10407 (an ETEC strain); and SECEC (an antibiotic resistant strain).

FIG. 4 shows the amino acid identity between pairs of sequences of NodT-family outer-membrane-factor-lipoprotein efflux transporter (orf1767). The labels are from left-to right and top-to-bottom: IHE3034 (an NMEC strain); RS218 (an NMEC strain); APEC01 (an APEC strain); CFT073 (an UPEC strain); 536 (an UPEC strain); UTI89 (an UPEC strain); F11 (an UPEC strain); EDL333 (an EHEC strain); Sakai (an EHEC strain); EC508 (an EHEC strain); EC863 (an EHEC strain); EC4024 (an EHEC strain); EC4042 (an EHEC strain); EC4054 (an EHEC strain); EC4076 (an EHEC strain); EC4113 (an EHEC strain); EC4115 (an EHEC strain); EC4196 (an EHEC strain); EC4206 (an EHEC strain); EC4401 (an EHEC strain); EC4486 (an EHEC strain); EC4501 (an EHEC strain); TW14588 (an EHEC strain); E2348/69 (an EPEC strain); and SECEC (an antibiotic resistant strain).

FIG. 5 shows the amino acid identity between pairs of sequences of gspK (orf3515). The labels are from left-to right and top-to-bottom: HS (a commensal strain); B (a Non-pathogenic strain); 8739 (a Non-pathogenic strain); C (a Non-pathogenic strain); IHE3034 (an NMEC strain); RS218 (an NMEC strain); APEC01 (an APEC strain); CFT073 (an UPEC strain); 536 (an UPEC strain); UTI89 (an UPEC strain); F11 (an UPEC strain); 101-1 (an EAEC strain); O42 (an EAEC strain); 53638 (an EIEC strain); B171 (an EPEC strain); E22 (an EPEC strain); E2348/69 (an EPEC strain); E110019 (an EPEC strain); B7A (an ETEC strain); E24377A (an ETEC strain); H10407 (an ETEC strain); and SECEC (an antibiotic resistant strain).

FIG. 6 shows the amino acid identity between pairs of sequences of gspJ (orf3516). The labels are from left-to right and top-to-bottom: HS (a commensal strain); IHE3034 (an NMEC strain); RS218 (an NMEC strain); APEC01 (an APEC strain); CFT073 (an UPEC strain); 536 (an UPEC strain); UTI89 (an UPEC strain); F11 (an UPEC strain); 101-1 (an EAEC strain); O42 (an EAEC strain); 53638 (an EIEC strain); B171 (an EPEC strain); E22 (an EPEC strain); E2348/69 (an EPEC strain); E110019 (an EPEC strain); B7A (an ETEC strain); E24377A (an ETEC strain); H10407 (an ETEC strain); and SECEC (an antibiotic resistant strain).

FIG. 7 shows the amino acid identity between pairs of sequences of tonB-dependent siderophore receptor (orf3597). The labels are from left-to right and top-to-bottom: IHE3034 (an NMEC strain); RS218 (an NMEC strain); APEC01 (an APEC strain); CFT073 (an UPEC strain); 536 (an UPEC strain); UTI89 (an UPEC strain); F11 (an UPEC strain); EDL333 (an EHEC strain); Sakai (an EHEC strain); EC508 (an EHEC strain); EC869 (an EHEC strain); EC4024 (an EHEC strain); EC4042 (an EHEC strain); EC4045 (an EHEC strain); EC4076 (an EHEC strain); EC4113 (an EHEC strain); EC4115 (an EHEC strain); EC4196 (an EHEC strain); EC4206 (an EHEC strain); EC4401 (an EHEC strain); EC4486 (an EHEC strain); EC4501 (an EHEC strain); TW14588 (an EHEC strain); O42 (an EAEC strain); E2348/69 (an EPEC strain); and SECEC (an antibiotic resistant strain).

FIG. 8 shows the amino acid identity between pairs of sequences of fibrial protein (orf3613). The labels are from left-to right and top-to-bottom: IHE3034 (an NMEC strain); RS218 (an NMEC strain); APEC01 (an APEC strain); CFT073 (an UPEC strain); 536 (an UPEC strain); and O42 (an EAEC strain).

FIG. 9 shows the amino acid identity between pairs of sequences of upec-948. The labels are from left-to right and top-to-bottom: HS (a commensal strain); B (a Non-pathogenic strain); C (a Non-pathogenic strain); RS218 (an NMEC strain); CFT073 (an UPEC strain); and E2348/69 (an EPEC strain).

FIG. 10 shows the amino acid identity between pairs of sequences of upec-1232. The labels are from left-to right and top-to-bottom: CFT073 (an UPEC strain); O42 (an EAEC strain); B7A (an ETEC strain); and H10407 (an ETEC strain).

FIG. 11 shows the amino acid identity between pairs of sequences of A chain precursor of the type-1 fimbrial protein (upec-1875). The labels are from left-to right and top-to-bottom: IHE3034 (an NMEC strain); RS218 (an NMEC strain); APEC01 (an APEC strain); CFT073 (an UPEC strain); UTI89 (an UPEC strain); F11 (an UPEC strain); EDL333 (an EHEC strain); Sakai (an EHEC strain); EC508 (an EHEC strain); EC869 (an EHEC strain); EC4024 (an EHEC strain); EC4042 (an EHEC strain); EC4045 (an EHEC strain); EC4076 (an EHEC strain); EC4113 (an EHEC strain); EC4115 (an EHEC strain); EC4196 (an EHEC strain); EC4206 (an EHEC strain); EC4401 (an EHEC strain); EC4486 (an EHEC strain); EC4501 (an EHEC strain); TW14588 (an EHEC strain); O42 (an EAEC strain); B171 (an EPEC strain); E22 (an EPEC strain); E2348/69 (an EPEC strain); E110019 (an EPEC strain); B7A (an ETEC strain); and SECEC (an antibiotic resistant strain).

FIG. 12 shows the amino acid identity between pairs of sequences of yapH homolog (upec-2820). The labels are from left-to right and top-to-bottom: CFT073 (an UPEC strain) and SECEC (an antibiotic resistant strain).

FIG. 13 shows the amino acid identity between pairs of sequences of hemolysin A (recp-3768). The labels are from left-to right and top-to-bottom: RS218 (an NMEC strain); APEC01 (an APEC strain); CFT073 (an UPEC strain); 536 (an UPEC strain); UTI89 (an UPEC strain); F11 (an UPEC strain); E110019 (an EPEC strain); B7A (an ETEC strain); E24377A (an ETEC strain); H10407 (an ETEC strain); and SECEC (an antibiotic resistant strain).

FIG. 14 shows the distribution and amino acid identity of candidates between strains.

BRIEF DESCRIPTION OF SEQUENCE LISTING

Figure 1:
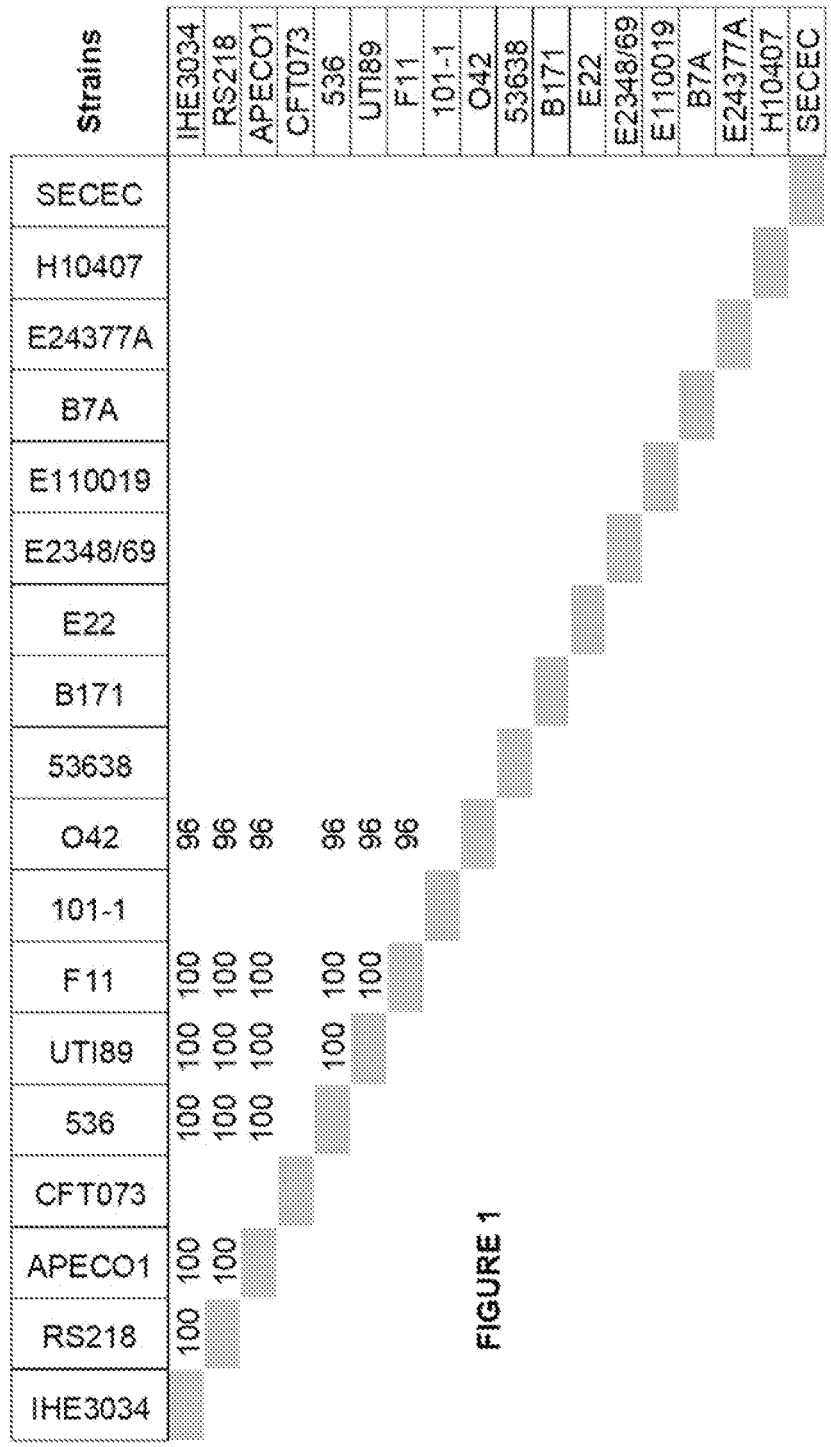
Figure 2:
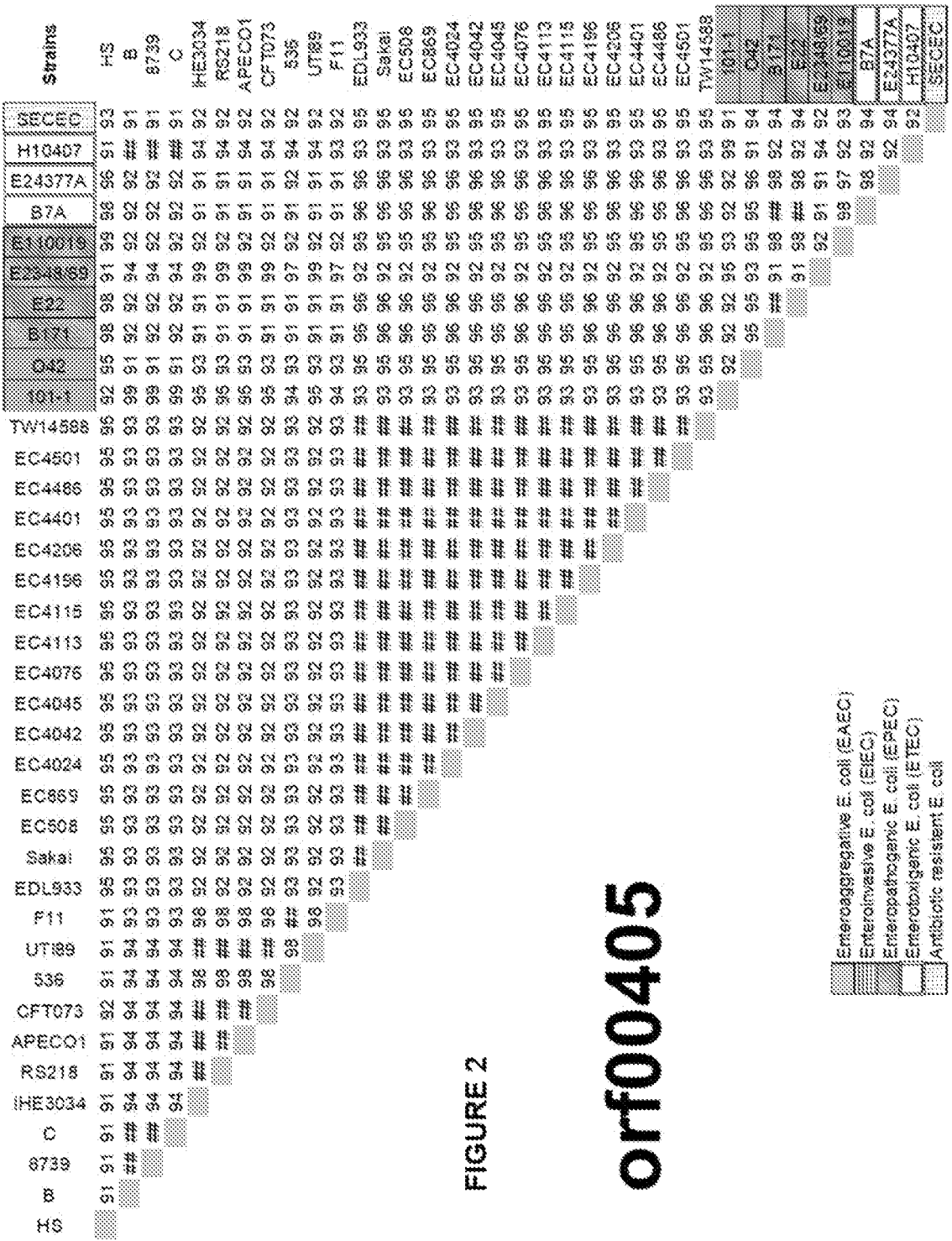
Figure 8:
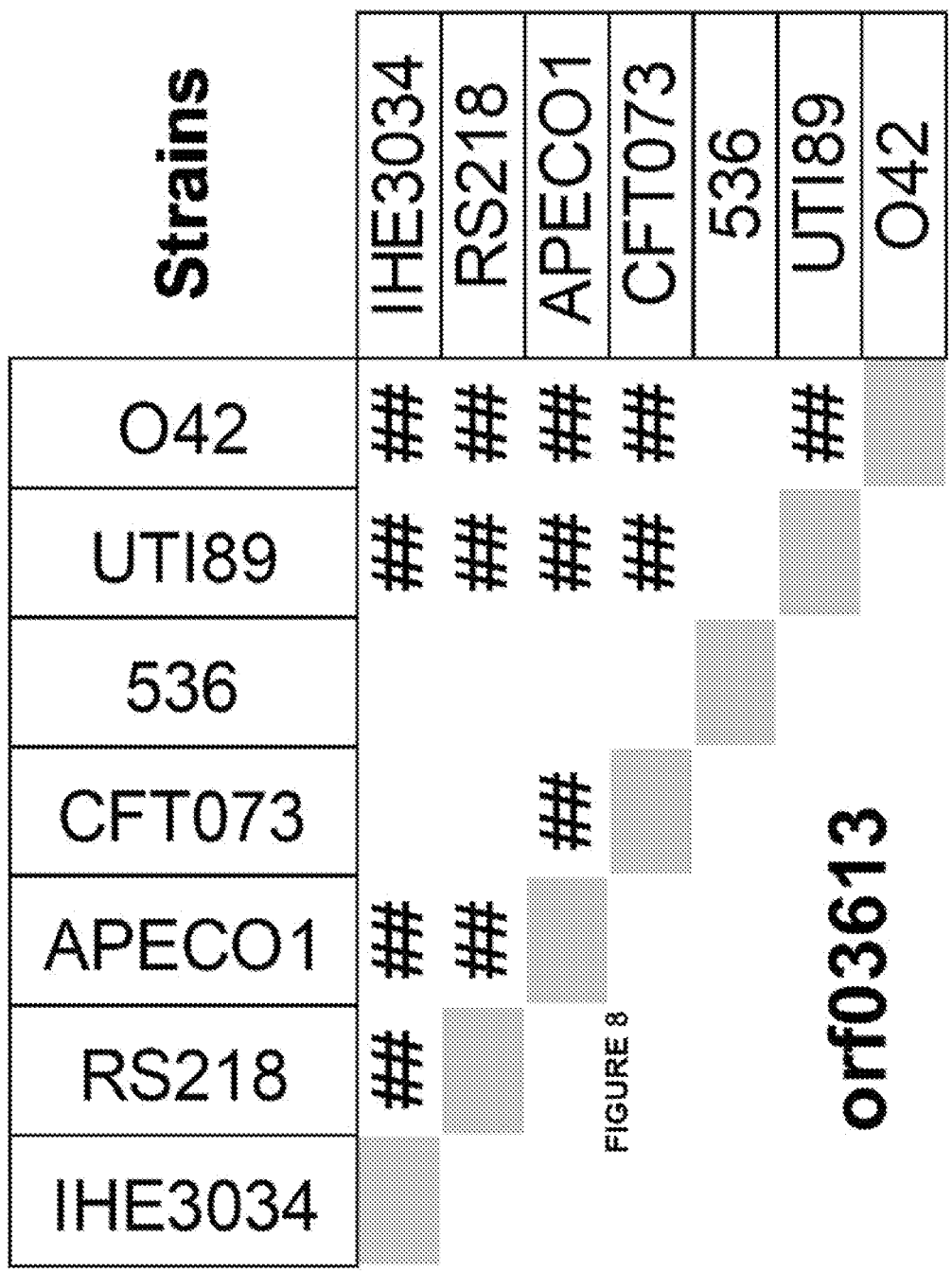
Figure 13:
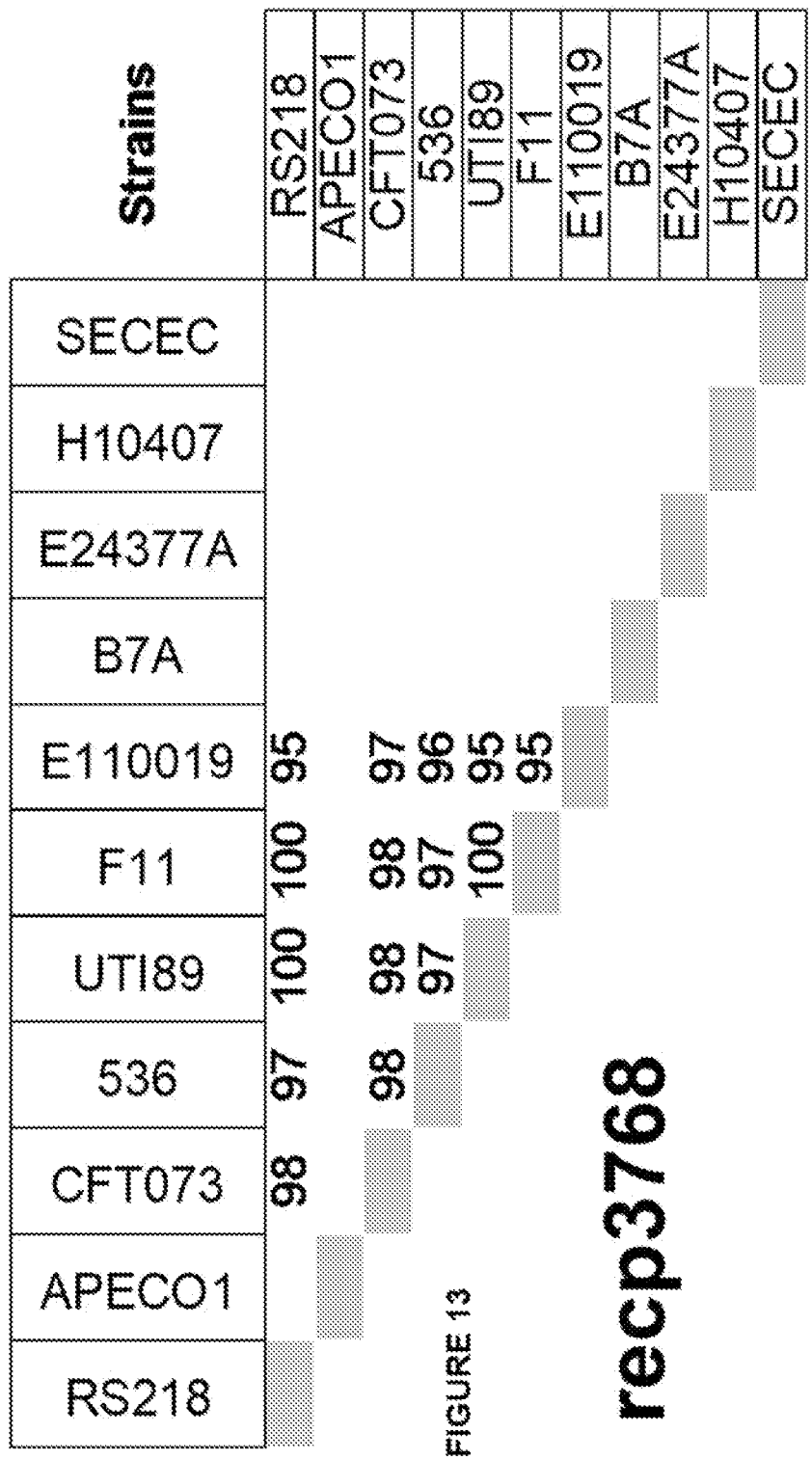

| SEQ ID | Description |
|---|---|
| 1-2 | Orf353 variants |
| 211-216 | Conserved Orf353 fragments |
| 217-218 | Conserved Orf353 linear B-cell epitopes |
| 3-18 | bacterial Ig-like domain (group 1) protein (orf405) variants |

-continued

| SEQ ID | Description |
|---|---|
| 219-271 | Conserved bacterial Ig-like domain (group 1) protein (orf405) fragments |
| 272-307 | Conserved bacterial Ig-like domain (group 1) protein (orf405) linear B-cell epitopes |
| 19-40 | Flu antigen 43 (orf1364) variants |
| 308-311 | Conserved flu antigen 43 (orf1364) fragments |
| 312-350 | Conserved flu antigen 43 (orf1364) linear B-cell epitopes |
| 41-47 | NodT-family outer-membrane-factor-lipoprotein efflux transporter (orf1767) variants |
| 351-361 | Conserved NodT-family outer-membrane-factor-lipoprotein efflux transporter (orf1767) fragments |
| 362-368 | Conserved NodT-family outer-membrane-factor-lipoprotein efflux transporter (orf1767) linear B-cell epitopes |
| 48-60 | gspK (orf3515) variants |
| 369-377 | Conserved gspK (orf3515) fragments |
| 378-384 | Conserved gspK (orf3515) linear B-cell epitopes |
| 61-71 | gspJ (orf3516) variants |
| 385-389 | Conserved gspJ (orf3516) fragments |
| 390-398 | Conserved gspJ (orf3516) linear B-cell epitopes |
| 72-79 | tonB-dependent siderophore receptor (orf3597) variants |
| 399-407 | Conserved tonB-dependent siderophore receptor (orf3597) fragments |
| 408-425 | Conserved tonB-dependent siderophore receptor (orf3597) linear B-cell epitopes |
| 80-81 | fibrial protein (orf3613) variants |
| 426 | Conserved fibrial protein (orf3613) fragment |
| 427-432 | Conserved fibrial protein (orf3613) linear B-cell epitopes |
| 82-84 | upec-948 variants |
| 493-495 | Conserved upec-948 fragment |
| 496-499 | Conserved upec-948 linear B-cell epitopes |
| 85-91 | upec-1232 variants |
| 500-502 | Conserved upec-1232 fragment |
| 503-506 | Conserved upec-1232 linear B-cell epitopes |
| 92-98 | A chain precursor of the type-1 fimbrial protein (upec-1875) variants |
| 507-510 | Conserved A chain precursor of the type-1 fimbrial protein (upec-1875) fragment |
| 511-515 | Conserved A chain precursor of the type-1 fimbrial protein (upec-1875) linear B-cell epitopes |
| 99-100 | yapH homolog (upec-2820) variants |
| 516-543 | Conserved yapH homolog (upec-2820) fragment |
| 544-638 | Conserved yapH homolog (upec-2820) linear B-cell epitopes |
| 101-105 | hemolysin A (recp-3768) variants |
| 433-463 | Conserved hemolysin A (recp-3768) fragment |
| 464-492 | Conserved hemolysin A (recp-3768) linear B-cell epitopes |
| 639 | Polynucleotide sequence for pUPEC-3768B4 encoding a fragment of hemolysin A (recp-3768) |
| 640 | Polypeptide sequence of the 3768B4 fragment of hemolysin A (recp-3768) |
| 641 | Polynucleotide sequence for pK1-0405B encoding a fragment of bacterial Ig-like domain (group 1) protein (orf405) |
| 642 | Polypeptide sequence of the 0405B fragment of bacterial Ig-like domain (group 1) protein (orf405) |
| 643 | Polynucleotide sequence for pCFT-2820A encoding a fragment of yapH homolog (upec-2820) |
| 644 | Polypeptide sequence of the 2820-A fragment of yapH homolog (upec-2820) |
| 645 | Polynucleotide sequence for pCFT-2820B encoding a fragment of yapH homolog (upec-2820) |
| 646 | Polypeptide sequence of the 2820-B fragment of yapH homolog (upec-2820) |
| 647 | Polynucleotide sequence for pCFT-2820C encoding a fragment of yapH homolog (upec-2820) |
| 648 | Polypeptide sequence of the 2820-C fragment of yapH homolog (upec-2820) |
| 649 | Polynucleotide sequence for pCFT-2820D encoding a fragment of yapH homolog (upec-2820) |
| 650 | Polypeptide sequence of the 2820-D fragment of yapH homolog (upec-2820) |
| 651 | Polynucleotide sequence for pK1-1364 encoding a fragment of flu antigen 43 (orf1364) |
| 652 | Polypeptide sequence of the K1-1364 fragment of bacterial Ig-like domain flu antigen 43 (orf1364) |
| 653-655 | *Escherichia* Sel1 repeat-containing protein (upec-5211) variants |
| 656-664 | *Escherichia* Sel1 repeat-containing protein (upec-5211) fragments |
| 665-676 | *Escherichia* Sel1 repeat-containing protein (upec-5211) linear B-cell epitopes |
| 677 | Polynucleotide sequence for pK1-0405AB encoding a fragment of bacterial Ig-like domain (group 1) protein (orf405AB) |
| 678 | Polynucleotide sequence for pK1-0405C encoding a fragment of bacterial Ig-like domain (group 1) protein (orf405C) |
| 679 | Polynucleotide sequence for pK1-0405BC encoding a fragment of bacterial Ig-like domain (group 1) protein (orf405BC) |
| 680 | Polypeptide sequence of the orf405AB of the bacterial Ig-like domain (group 1) protein (orf405) |
| 681 | Polypeptide sequence of the orf405C of the bacterial Ig-like domain (group 1) protein (orf405) |

| SEQ ID | Description |
|---|---|
| 682 | Polypeptide sequence of the orf405BC of the bacterial Ig-like domain (group 1) protein (orf405) |
| 683 | Conserved bacterial Ig-like domain (group 1) protein (orf405) fragment |

MODES FOR CARRYING OUT THE INVENTION orf353, bacterial Ig-like domain (group 1) protein (orf405), flu antigen 43 (orf1364), NodT-family outer-membrane-factor-lipoprotein efflux transporter (orf1767), gspK (orf3515), gspJ (orf3516), tonB-dependent siderophore receptor (orf3597), fibrial protein (orf3613), upec-948, upec-1232, A chain precursor of the type-1 fimbrial protein (upec-1875), yapH homolog (upec-2820), hemolysin A (recp-3768), and Sel1 repeat-containing protein (upec-5211), each as more fully described herein, have been expressed and purified, and confer protection against ExPEC strains in a sepsis animal model.

Sequences were obtained for the orthologs in various other E. coli strains.

Exemplary antigens for each of the protein—orf353 (SEQ ID NO:1—amino acids 21-162), bacterial Ig-like domain (group 1) protein (orf405) (SEQ ID NO:9—amino acids 595-1008), flu antigen 43 (orf1364) (SEQ ID NO: 27—amino acids 53-629), NodT-family outer-membrane-factor-lipoprotein efflux transporter (orf1767) (SEQ ID NO: 41—amino acids 15-457), gspK (orf3515) (SEQ ID NO: 56—amino acids 32-325), gspJ (orf3516) (SEQ ID NO:65—amino acids 16-189), tonB-dependent siderophore receptor (orf3597) (SEQ ID NO:74—amino acids 29-713), fibrial protein (orf3613) (SEQ ID NO:80—amino acids 28-187), upec-948 (SEQ ID NO: 82—amino acids 24-151), upec-1232 (SEQ ID NO:89—amino acids 26-151), A chain precursor of the type-1 fimbrial protein (upec-1875) (SEQ ID NO:97—amino acids 25-187), yapH homolog (upec-2820) (SEQ ID NO:99), hemolysin A (recp-3768) (SEQ ID NO:103—amino acids 24-1024), and Sel1 repeat-containing protein (upec-5211) (SEQ ID NO:653)—were cloned in pET-21b vectors (Novagen) and transformed in DH5α-T1 chemically competent cells for propagation (Invitrogen). BL21 (DE3) chemically competent cells were used for expression. All candidates were cloned and expressed without the signal sequence and as his-tag fusion proteins. Candidates were purified by affinity chromatography.

Protection was evaluated in a sepsis animal model. CD1 out bred female mice (5 weeks old) from Charles River Italia were immunized by subcutaneous injections at the 1st, 21st and 35th days with 20 µg of recombinant protein in Freund's adjuvant. Positive control was immunized with 10^8 heat-inactivated bacteria (65° C. for 30 minutes) in 0.15 ml of physiological solution in Freund's adjuvant (Sigma); while negative control was immunized with physiologic solution in Freund's adjuvant. Challenge was done at the 49th day with a dose of $10^7$ of fresh bacterial culture/mouse ($LD_{80}$) by intraperitoneal (for strains IHE3034 and CFT073) or intravenous (for strain 536) injection. Heparinised-blood samples were collected from survived mice at 24 hours after challenge to determine bacteremia levels and the mortality was observed for four days after challenge.

| | Sepsis Animal Model | | |
|---|---|---|---|
| Candidate | Survival with vaccination (%) | Survival without vaccination (%) | P value |
| hemolysin A (recp-3768) | 18/23 (78) | 2/26 (7) | <0.0001 |
| upec-1232 | 15/30 (50) | 3/36 (8) | 0.0002 |
| gspK (orf3515) | 30/110 (27) | 11/116 (9) | 0.0005 |
| upec-5211 | 30/83 (36) | 14/91 (15) | 0.003 |
| tonB-dependent siderophore receptor (orf3597) | 12/40 (32) | 5/48 (10) | 0.03 |
| orf353 | 19/76 (25) | 7/67 (10) | 0.03 |
| gspJ (orf3516) | 10/46 (21) | 3/50 (6) | 0.03 |
| NodT-family outer-membrane-factor-lipoprotein efflux transporter (orf1767) | 15/74 (20) | 6/80 (7) | 0.03 |
| A chain precursor of the type-1 fimbrial protein (upec-1875) | 11/23 (47) | 5/26 (19) | 0.06 |
| fibrial protein (orf3613) | 24/89 (27) | 13/81 (16) | 0.09 |
| upec-948 | 12/31 (38) | 7/38 (18) | 0.1 |

Certain of the above candidates showed limited or no solubility as full length proteins (hemolysin A (recp-3768), flu antigen 43 fragment (orf1364), bacterial Ig-like domain (group 1) protein (orf405), and yapH homolog (upec-2820)). Therefore, fragments were constructed and tested for solubility. Those that demonstrated increased solubility were further tested for their ability to provide protection in the sepsis animal model as described above.

| | Sepsis Animal Model | | |
|---|---|---|---|
| Candidate fragment | Survival with vaccination (%) | Survival without vaccination (%) | P value |
| 2820-D (yapH homolog fragment D) (SEQ ID NO: 650) | 10/34 (29) | 3/36 (8) | 0.03 |
| 1364 (flu antigen 43 fragment) (SEQ ID NO: 652) | 21/77 (27) | 8/84 (9) | 0.004 |
| 405B (bacterial Ig-like domain (group 1) protein fragment) (SEQ ID NO: 642) | 25/81 (30.8) | 14/86 (16) | 0.03 |
| 3768-B4 (with Alum) (hemolysin A fragment B4) (SEQ ID NO: 640) | 13/24 (54) | 6/24 (25) | 0.07 |
| 2820-C (yapH homolog fragment C) (SEQ ID NO: 648) | 9/32 (28) | 4/38 (10) | 0.07 |
| 2820-A (yapH homolog fragment A) (SEQ ID NO: 644) | 8/24 (33) | 5/28 (17.8) | 0.2 |
| 2820-B (yapH homolog fragment B) (SEQ ID NO: 646) | 10/31 (32) | 10/38 (26) | 0.6 |

To demonstrate the ability of the hemolysin A protein fragment B4 (3768-B4) to provide cross protection against other strains, mice immunized with the above hemolysin A protein fragment B4 (3768-B4) were challenged with different strains of E, coli, as shown in the following table.

| | Protection in Sepsis Animal Model | | | |
|---|---|---|---|---|
| | 3768-B4 20 µg/Alum | | 3768 (insol.) 20 µg/Alum | |
| E. Coli Strain | Survival with vaccination (%) | Survival without vaccination (%) | Survival with vaccination (%) | Survival without vaccination (%) |
| 536 | 13/24 (54) | 6/24 (25) | 10/16 (62.5) | 0/16 (0) |
| CFT073 | 3/8 (37.5) | 2/8 (25) | — | — |
| BK658 | 1/8 (12.5) | 1/8 (12.5) | 6/8 (75) | 1/8 (12.5) |

Various combinations of the three fragments of bacterial Ig-like domain (group 1) protein fragment (orf405) were tested in the mouse model of sepsis as described above. The results are provided in the following table.

| | Sepsis Animal Model | | |
|---|---|---|---|
| Candidate fragment | Survival with vaccination (%) | Survival without vaccination (%) | P value |
| 405AB (SEQ ID NO: 680) | 2/8 (25) | 0/8 (0) | 0.4 |
| 405BC (SEQ ID NO: 682) | 0/8 (27) | 0/8 (0) | — |
| 405B (SEQ ID NO: 642) | 25/81 (30.8) | 14/86 (16) | 0.03 |
| 405C (SEQ ID NO: 681) | 0/10 (0) | 1/10 (1) | — |

It will be understood that the invention has been described by way of example only and modifications may be made whilst remaining within the scope and spirit of the invention.

REFERENCES

[1] Kaper et al. (2004) *Nat Rev Microbiol.* 2(2):123-40.
[2] Anjum et al. (2007) *Appl Environ Microbial* 73:5692-7.
[3] Russo & Johnson (2000) *J Infect Dis* 181:1753-1754.
[4] Smith et al. (2007) *Foodborne Pathogens And Disease* 4:134-63.
[5] WO2006/089264.
[6] WO2006/091517.
[7] Needleman & Wunsch (1970) *J. Mol. Biol.* 48, 443-453.
[8] Rice et al. (2000) *Trends Genet.* 16:276-277.
[9] Geysen et al. (1984) *PNAS USA* 81:3998-4002.
[10] Carter (1994) *Methods Mol Biol* 36:207-23.
[11] Jameson, B A et al. 1988, *CABIOS* 4(1):181-186.
[12] Raddrizzani & Hammer (2000) *Brief Bioinform* 1(2):179-89.
[13] Bublil et al. (2007) *Proteins* 68(1):294-304.
[14] De Lalla et al. (1999) *J. Immunol.* 163:1725-29.
[15] Kwok et al. (2001) *Trends Immunol* 22:583-88.
[16] Brusic et al. (1998) *Bioinformatics* 14(2):121-30
[17] Meister et al. (1995) *Vaccine* 13(6):581-91.
[18] Roberts et al. (1996) *AIDS Res Hum Retroviruses* 12(7):593-610,
[19] Maksyutov & Zagrebelnaya (1993) *Compact Appl Biosci* 9(3):291-7.
[20] Feller & de la Cruz (1991) *Nature* 349(6311):720-1.
[21] Hopp (1993) *Peptide Research* 6:183-190.
[22] Welling et al. (1985) *FEBS Lett.* 188:215-218.
[23] Davenport et al. (1995) *Immunogenetics* 42:392-297.
[24] Chen et al. (2007) *Amino Acids* 33(3):423-8.
[25] U.S. Pat. No. 5,707,829
[26] *Current Protocols in Molecular Biology* (F. M. Ausubel et al. eds., 1987) *Supplement* 30.
[27] *Vaccine Design: The Subunit and Adjuvant Approach* (eds. Powell & Newman) Plenum Press 1995 (ISBN 0-306-44867-X).
[28] *Vaccine Adjuvants: Preparation Methods and Research Protocols* (Volume 42 of *Methods in Molecular Medicine* series). ISBN: 1-59259-083-7. Ed. O'Hagan.
[29] U.S. Pat. No. 6,355,271.
[30] WO00/23105.
[31] WO90/14837.
[32] WO90/14837.
[33] Podda (2001) *Vaccine* 19: 2673-2680.
[34] *Vaccine Design: The Subunit and Adjuvant Approach* (eds. Powell & Newman) Plenum Press 1995 (ISBN 0-306-44867-X).
[35] *Vaccine Adjuvants: Preparation Methods and Research Protocols* (Volume 42 of *Methods in Molecular Medicine* series). ISBN: 1-59259-083-7. Ed. O'Hagan.
[36] Allison & Byars (1992) *Res Immunol* 143:519-25.
[37] Hariharan et al. (1995) *Cancer Res* 55:3486-9.
[38] US-2007/014805.
[39] Suli et al. (2004) *Vaccine* 22(25-26):3464-9.
[40] WO95/11700.
[41] U.S. Pat. No. 6,080,725.
[42] WO2005/097181.
[43] WO2006/113373.
[44] Han et al. (2005) *Impact of Vitamin E on Immune Function and Infectious Diseases in the Aged* at Nutrition, Immune functions and Health EuroConference, Paris, 9-10 Jun. 2005.
[45] U.S. Pat. No. 6,630,161.
[46] U.S. Pat. No. 5,057,540.
[47] WO96/33739.
[48] WO96/11711.
[49] WO00/07621.
[50] Barr et al. (1998) *Advanced Drug Delivery Reviews* 32:247-271.
[51] Sjolanderet et al. (1998) *Advanced Drug Delivery Reviews* 32:321-338.
[52] Niikura et al. (2002) *Virology* 293:273-280.
[53] WO03/024481.
[54] Gluck el at (2002) *Vaccine* 20:B10-B16.
[55] EP-A-0689454.
[56] Johnson et al. (1999) *Bioorg Med Chem Lett* 9:2273-2278.
[57] Evans et al. (2003) *Expert Rev Vaccines* 2:219-229.
[58] Meraldi et al. (2003) *Vaccine* 21:2485-2491.
[59] Pajak et al. (2003) *Vaccine* 21:836-842.
[60] Kandimalla et al. (2003) *Nucleic Acids Research* 31:2393-2400.
[61] WO02/26757.
[62] WO99/62923.
[63] Krieg (2003) *Nature Medicine* 9:831-835.
[64] U.S. Pat. No. 6,429,199.
[65] Kandimalla et al. (2003) *Biochemical Society Transactions* 31 (part 3):654-658.
[66] Blackwell et al. (2003) *J Immunol* 170:4061-4068.
[67] WO01/95935.
[68] Kandimalla et al. (2003) *BBRC* 306:948-953.
[69] WO03/035836.
[70] WO01/22972.
[71] Schellack et al. (2006) *Vaccine* 24:5461-72.
[72] WO95/17211.
[73] WO98/42375.
[74] Beignon et al. (2002) *Infect Immun* 70:3012-3019.
[75] Pine et al. (2002) *J Control Release* 85:263-270.
[76] Tebbey et al. (2000) *Vaccine* 18:2723-34.
[77] Domenighini et al. (1995) *Mol Microbiol* 15:1165-1167.
[78] WO99/40936.
[79] WO99/44636.

[80] Singh et all (2001) *J Cont Release* 70:267-276.
[81] WO99/27960.
[82] U.S. Pat. No. 6,090,406.
[83] EP-A-0626169.
[84] WO99/52549.
[85] WO01/21207.
[86] WO01/21152.
[87] Andrianov et al. (1998) *Biomaterials* 19:109-115.
[88] Payne et al. (1998) *Adv Drug Delivery Review* 31:185-196.
[89] U.S. Pat. No. 4,680,338.
[90] U.S. Pat. No. 4,988,815.
[91] WO92/15582.
[92] Stanley (2002) *Clin Exp Dermatol* 27:571-577.
[93] Jones (2003) *Curr Opin Investig Drugs* 4:214-218.
[94] WO03/011223.
[95] Johnson et al. (1999) *Bioorg Med Chem Lett* 9:2273-2278.
[96] Evans et al. (2003) *Expert Rev Vaccines* 2:219-229.
[97] WO2004/060308.
[98] WO2004/064759.
[99] U.S. Pat. No. 6,924,271.
[100] U.S. Pat. No. 5,658,731.
[101] U.S. Pat. No. 5,011,828.
[102] WO2004/87153.
[103] U.S. Pat. No. 6,605,617.
[104] WO02/18383.
[105] WO2004/018455.
[106] WO03/082272.
[107] Wong et al. (2003) *J Clin Pharmacol* 43(7):735-42.
[108] US2005/0215517.
[109] Dyakonova et al. (2004) *Int Immunopharmacol* 4(13):1615-23.
[110] FR-2859633.
[111] Signorelli & Hadden (2003) *Int Immunopharmacol* 3(8):1177-86.
[112] WO2004/064715.
[113] De Libero et al, *Nature Reviews Immunology*, 2005, 5: 485-496
[114] WO03/105769
[115] Cooper (1995) *Pharm Biotechnol* 6:559-80.
[116] WO99/11241.
[117] WO94/00153.
[118] WO98/57659.
[119] European patent applications 0835318, 0735898 and 0761231.
[120] Durant et al. (2007) *Infect Immun* 75:1916-25.
[121] WO02/081653.
[122] Donnelly et al. (1997) *Annu Rev Immunol* 15:617-648.
[123] *Gene Vaccination: Theory and Practice* (1998) ed. Raz (ISBN 3540644288).
[124] Findeis et al., *Trends Biotechnol.* (1993) 11:202
[125] Wu et al., *J. Biol. Chem.* (1991) 266:338
[126] Jolly, *Cancer Gene Therapy* (1994) 1:51
[127] Kaplitt, *Nature Genetics* (1994) 6:148
[128] WO 90/07936.
[129] WO 91/02805.
[130] WO 94/12649.
[131] WO 95/00655.
[132] Curiel, *Hum. Gene Ther.* (1992) 3:147
[133] Wu, *J. Biol. Chem.* (1989) 264:16985
[134] U.S. Pat. No. 5,814,482.
[135] WO 97/42338.
[136] WO 90/11092.
[137] U.S. Pat. No. 5,580,859
[138] U.S. Pat. No. 5,422,120
[139] EP-0524968.
[140] Philip, *Mol. Cell. Biol.* (1994) 14:2411
[141] Woffendin, *Proc. Natl. Acad. Sci.* (1994) 91:11581
[142] U.S. Pat. No. 5,206,152.
[143] WO 92/11033.
[144] U.S. Pat. No. 5,149,655.
[145] Brandt et al. (2006) *J Antimicrob Chemother.* 58(6): 1291-4. Epub 2006 Oct. 26
[146] Winter et al., (1991) *Nature* 349:293-99
[147] U.S. Pat. No. 4,816,567.
[148] Inbar et al., (1972) *Proc. Natl. Acad. Sci. U.S.A.* 69:2659-62.
[149] Ehrlich et al., (1980) *Biochem* 19:4091-96.
[150] Huston et al., (1988) *Proc. Natl. Acad. Sci. U.S.A.* 85:5897-83.
[151] Pack et al., (1992) *Biochem* 31, 1579-84.
[152] Cumber et al., (1992) *J. Immunology* 149B, 120-26.
[153] Riechmann et al., (1988) *Nature* 332, 323-27.
[154] GB 2,276,169.
[155] Gennaro (2000) *Remington: The Science and Practice of Pharmacy.* 20th edition, ISBN: 0683306472.
[156] *PCR (Introduction to Biotechniques Series)*, 2nd ed. (Newton & Graham eds., 1997, Springer Verlag)
[157] *Current Protocols in Molecular Biology* (F. M. Ausubel et al., eds., 1987) Supplement 30
[158] Smith & Waterman (1981) *Adv. Appl. Math.* 2: 482-489.
[159] Welch et al. (2002) *Proc. Natl. Acad. Sci. U.S.A.* 99(26) 17020-17024.

SEQ ID NO: 639
```
GATAAGTTTTTGGCAGCAAATTTACAGATATCTTCCATGGCGCGGATGGTGATGACCACATAGAAGGAAATGATGGGAAT
GACCGCTTATATGGTGATAAAGGTAATGACACACTGAGGGGCGGAAACGGGGATGACCAGCTCTATGGCGGTGATGGTAAC
GATAAGCTAACCGGAGGTGTGGGTAATAACTACCTTAATGGCGGAGACGGGGATGATGAGCTTCAGGTTCAGGGTAATTCT
CTTGCTAAAAATGTATTATCCGGTGGAAAAGGTAATGACAAGCTGTACGGCAGTGAGGGGGCAGATCTGCTTGATGGCGGA
GAAGGGAATGATCTCCTGAAGGGGGGTATGGTAATGATATTTATCGTTATCTTTCAGGATATGGCCATCATATTATTGAC
GATGATGGGGAAAAGACGATAAACTCAGTTTGGCTGATATTGATTTCCGGGACGTTGCCTTTAAGCGAGAAGGAAATGAC
CTCATCATGTATAAAGCTGAAGGTAATGTTCTTTCCATTGGTCATAAAAATGGTATTACATTCAGGAACTGGTTTGAAAAA
GAGTCAGGTGATATCTCTAATCACCAGATAGAGCAGATTTTTGATAAAGATGGCCGG
```

SEQ ID NO: 640
```
DKFFGSKFTDIFHGADGDDHIEGNDGNDRLYGDKGNDTLRGGNGDDQLYGGDGNDKLTGGVGNNYLNGGDGDDELQVQGNS
LAKNVLSGGKGNDKLYGSEGADLLDGGEGNDLLKGGYGNDIYRYLSGYGHHIIDDDGGKDDKLSLADIDFRDVAFKREGND
LIMYKAEGNVLSIGHKNGITPRNWFEKESGDISNHQIEQIFDKDGR
```

SEQ ID NO: 641
```
GTTGCTGATGGTCAGCAAGCCTACACGCTGACACTGACAGCGGTGGACTCCGAGGGTAATCCGGTGACGGGAGAAGCCAGC
CGCCTGCGACTTGTTCCGCAAGACACTAATGGTGTAACCGTTGGTGCCATTTCGGAAATAAAACCAGGGGTTTACAGCGCC
ACGGTTTCTTCGACCCGTGCCGGAAACGTTGTTGTGCGTGCCTTCAGCGAGCAGTATCAGCTGGGCACATTACAACAAACG
CTGAAGTTTGTTGCCGGGCCGCTTGATGCAGCACATTCGTCCATCACACTGAATCCTGATAAACCGGTGGTTGGCGGTACA
GTTACGGCAATCTGGACGGCAAAAGATGCTAATGACAACCCTGTAACTGGCCTCAATCCGGATGCACCGTCATTATCGGGC
```

```
GCAGCTGCTGCTGGTTCTACGGCATCAGGCTGGACGGATAATGGCGACGGGACCTGGACTGCGCAGATTTCTCTCGGCACT
ACGGCGGGTGAATTAGACGTTATGCCGAAGCTCAATGGGCAGGACGCGGCAGCAAATGCGGCAAAAGTAACCGTGGTGGCT
GATGCATTATCTTCAAACCAGTCGAAAGTCTCTGTCGCAGAAGATCACGTAAAAGCCGGTGAAAGCACAACCGTAACGCTG
GTGGCGAAAGATGCGCATGGCAACGCTATCAGTGGTCTTTCGTTGTCGGCAAGTTTGACGGGACCGCCTCTGAAGGGGCG
ACCGTTTCCAGTTGGACCGAAAAAGGTGACGGTTCCTATGTTGCTACGTTAACTACAGGCGGAAAGACGGGCGAGCTTCGT
GTCATGCCGCTCTTCAACGGCCAGCCTGCAGCCACCGAAGCCGCGCAGCTGACTGTTATTGCCGGAGAGATGTCATCAGCG
AACTCTACGCTTGTTGCGGACAATAAAACTCCAACGGTTAAAACGACGACGGAACTCACCTTCACCATGAAGGATGCGTAC
GGGAATCCGGTCACCGGGCTGAAGCCAGATGCACCAGTGTTTAGTGGTGCCGCCAGCACGGGGAGTGAGCGTCCTTCAGCA
GGAAACTGGACAGAGAAAGGTAATGGGGTCTACGTGTCGACCTTAACGCTGGGATCTGCCGCGGGTCAGTTGTCTGTGATG
CCGCGAGTGAACGGCCAAAATGCCGTTGCTCAGCCACTGGTGCTGAATGTTGCAGGTGACGCATCTAAGGCTGAGATTCGT
GATATGACAGTGAAGGTTAATAACCAA

SEQ ID NO: 642
VADGQQAYTLTLTAVDSEGNPVTGEASRLRLVPQDTNGVTVGAISEIKPGVYSATVSSTRAGNVVVRAFSEQYQLGTLQQT
LKFVAGPLDAAHSSITLNPDKPVVGGTVTAIWTAKDANDNPVTGLNPDAPSLSGAAAAGSTASGWTDNGDGTWTAQISLGT
TAGELDVMPKLNGQDAAANAAKVTVVADALSSNQSKVSVAEDHVKAGESTTVTLVAKDAHGNAISGLSLSASLTGTASEGA
TVSSWTEKGDGSYVATLTTGGKTGELRVMPLFNGQPAATEAAQLTVIAGEMSSANSTLVADNKTPTVKTTTELTFTMKDAY
GNPVTGLKPDAPVFSGAASTGSERPSAGNWTEKGNGVYVSTLTLGSAAGQLSVMPRVNGQNAVAQPLVLNVAGDASKAEIR
DMTVKVNNQ

SEQ ID NO: 643
ATTAATTGCAATAACGCAATGGCAGATGTCATATTGTCACCAGACTGGCGTCCGGGTACGAATAACTCGGGTGTTGGGGCT
GCAACAGTAAGTGGTAAAACCGAATACATCACTGGTCCAAATGTCGTCCAGTCTGGTGGGTCAGGTCTTATCTGGATGACT
GTAGAACAGGCAATTTTAAATGGCTACACCACTGGAGATAATTTATCCGGATTGATTTACGTCAATACCGGAGAAAAACA
AAAACCATTACAGTGAAGGATGAGGTTACTGGCGCTTCTCAAACACTTCAAGTGTTTGATACTGACTCTTTCTCACAACGC
GATGCGGGGACTGGGGGAAATGAAACCATTCCTGGTTTTAGTGGCACTGCGGATTTTTTCAATGCGACACGTTTTGTAACA
GCCAATAATGGCGGTACAGCTATTTTGGATGTGGGTTCACCAGCAATCGGTAATTTTTTTAAAAATACACAGCTTGCTGTA
GCTGATGGAGAAGGTTCCTCTGTTGTATGGAACTCGGTCAATGATTTTTATTTTCAGCCTGGTGCAACCATGCAGGGGGGC
GGCGTTACTCAAAAAATCATTGACTCAATGAAATATGCTGGAACAATTACTGATTGGGCGGGAAAAGTACACCATATTAAC
TCTCTTGATGATTTAAAGCAATATAATCAATATTTGATAAAGTCACTAGAGGACAAAACGCTTTCTTATAAGCAGTATGAT
GCTGAATTTAATAAGGCCCTTATTGTCACCAAGCATAATTACAATGTGGATATGACCGCTGGGGGACGTATAGACTCAACT
CCTTACAAAGAAAATGTAGGGCTGCTTGCTGTTCTCCATGCAACCAATAACGCACGAGCAATATAGGTAAAACGGGTAAA
TTAACTGGAGTTCTTCCTGCCTATGGGAATGGAGGAGGGATCGTTGCAACTAATGGTGGGACCGGTGTTAATGAAGGGGTC
ATTGATGCCATTGGTACTGAAATGATTGCCTATCAAGACTATCACCATTGTTAACGATGGTACACTTTTTGTTTGGGATAAT
AATGATAAATATGCTCTCCAGGCAGAGGGGATGGTTGCCGGTAGTAATGGTTCTTCAGCCATTAATAATGGTGTTATTAAT
ATTCGCCCATTTAAAAATGCTTTCGCTCCAGAGGGGATTAACACCGCAATTGTTGTTAGTAATGGGGGCATGGCAACAAAT
AAAGGCACAATAAATATTACTGCCGATGCATCAACTAATGATAATAATGGCAAAACACGAGGTGTAAATGTTGGAGCTGGA
GGCTCTTTTATTAACTCGGCCTTCGGGAGCATCAATGTAGGTATTGCGGAGGATAAAACTGCGACTCATTCGGCTGTGGGT
TCTGTTGCGATTGAAGTACAAAATGGTGCAAACAAAGTCGTTAATGAAGGTACTATTTTTTTGGGCAGGGGGGCTCAGGGG
AACTACGGAATCCTGGCAAAGGATGCCGGGACTGTTGATGTGGTAAATAAAGGGACTATCACTATTGACGGTCATGACAGT
GAT

SEQ ID NO: 644
INCNNAMADVILSPDWRPGTNNSGVGAATVSGKTEYITGPNVVQSGGSGLIWMTVEQAILNGYTTGDNLSGLIYVNTGEKT
KTITVKDEVTGASQTLQVFDTDSFSQRDAGTGGNETIPGFSGTADFFNATRFVTANNGGTAILDVGSPAIGNFFKNTQLAV
ADGEGSSVVWNSVNDFYFQPGATMQGGVTQKIIDSMKYAGTITDWAGKVHHINSLDDLKQYNQYLIKSLEDKTLSYKQYD
AEFNKALIVTKHNYNVDMTAGGRIDSTPYKENVGLLAVLHATNNARAILGKTGKLTGVLPAYGNGGGIVATNGGTGVNEGV
IDAIGTEMIAYQDSTIVNDGTLFVWDNNDKYALQAEGMVAGSNGSSAINNGVININRPFKNAFAPEGINTAIVVSNGGMATN
KGTININITADASTNDNNGKTRGVNVGAGGSFINSAFGSINVGIAEDKTATHSAVGSVAIEVQNGANKVVNEGTIFLGRGAQG
NYGILAKDAGTVDVVNKGTITIDGHDSD

SEQ ID NO: 645
GCACCTGCACTGAATGTTGGCATGCTGGCAAATAATAGCTCCGGGATGAAAAACTCCGGGATTATCAATGTTAATGGTCTG
AACAGCACCGGGCTACAGGTAATCAATGCAGGACAGTTGAATTCTGACGGTACAATAAATGTTGGCGGCAAGGGTATCAGT
AGTGGTTTCCGTAACTATGGTGCCTGGGTGGAAGGTGCCGGAAGCAATGTTAATGTATCCGGAAAAATCAGTCTTGCCGGT
ACGGGGGCTGTGGGGGTTTTTGCTAAAGATGGCGGCAGTCTGACCCTGTCAGGCAATGGTGCAGTGCTATTTGGCAGCAGC
GATCAGATAGGCTTTTATGTCTATGGAAAGGACTCTGCCATTCATAATACCGGAAGCGGTGTTATGGATGTGTCCACTGAA
AACTCAACATTATTCCGTATTGCCAGTGGTGCGACATTCCAGGGAACTGCAGATGCTTCTTCTGCACTTACGGCGTCTGGT
AAGAACTCTTATGCACTTATTGCCACGGGGAAATCGGATGGCGGTGTGGCCTCGACAGTAACGTCTGGAGGAATGACCATC
AACCTGACGGGTGAGGGGCTACAGCGACTTTAATTGAAGGGGAGCGCAGGGCACAATTGAAGTAATGCCATTATCAAT
ATGGATAATGCCAGTGCATAGCCGGTATTGCGGATGGCAATGGCTATGATATTTCCGGCAAACTCATTAATCCGAAGGAC
AAGACCACACTATTAACGGCGGGGCTCAGTTAAGTTCCACCCAGGATAAAGTGACCGGGTATATCGCCCGTAATGGGGCC
ACTCTAAATAATACCGGTAATATCATCTTTACTGGAAAGAATACAGTGGGCGTCCGGGTTGAGGAGGGGCGTGTTGGTACC
AACAGCGGAAATATTACAGTTCAGGATGGTGCTGTGGGACTAATTGCTAATGCCACACAAGATGTTACAACGATTAATAAC
TCGGGAAATCTCGTTCTCAAGGGAGGAGATAATGCTAACCGTACAACGGGTATAAAAGCATCTGGTACAACAACAACGGTT
AATATGACCGCGGGTACTATATCTTTGCAGGGACAGGGGGCGATTGGCGTTGAGGCCAGCAATAAAGGGACTGTTAACCTT
GATGGTTCGGCAGTACCGAACTTTGCTGCTGACGGCTCTGGTATTACCGATCAGATTGCTTTCGTATTATCGGAGATGGT
GCAACCATTAAGACGAATATTGCACCGGGAACTCTGCTGGATGCCAGT

SEQ ID NO: 646
APALNVGMLANNSSGMKNSGIINVNGLNSTGLQVINAGQLNSDGTINVGGKGISSGFRNYGAWVEGAGSNVNVSGKISLAG
TGAVGVFAKDGGSLTLSGNGAVLEGSSDQIGFYVYGKDSAIHNTGSGVMDVSTENSTLFRIASGATFQGTADASSALTASG
KNSYALIATGKSDGGVASTVTSGGMTINLTGEGATATLIEGGAQGTIESNAIINMDNASAIAGIADGNGYDISGKLINPKD
KTTLLTAGAQLSSTQDKVTGYIARNGATLNNTGNIIFTGKNTVGVRVEEGAVGTNSGNITVQDGGVGLIANATQDVTTINN
SGNLVLKGGDNANRTTGIKASGTTTTVNMTAGTISLQGQGAIGVEASNKGTVNLDGSAVPNFAADGSGITDQIAFRIIGDG
ATIKTNIAPGTLLDAS

SEQ ID NO: 647
GGGGAACGTTCTGTACTTTTCCGTATTGAAGATGGGGCAAAACAGGCCGGCTCTCTGCTGATGAAAACCTCCGGGACAGGC
AGCCGTGGTATCTGGGCCACAGGGAAAGGGAGCAATGTCCTGGCTGATGCTGGCAGTGATTTCCAGATCCTGGGCGCTCAG
```

-continued

```
GCTCAGGGATTATATGTAACTGGTGGTGCGACAGCGACGCTGAAACAGGGGGCATCAGTTAACCTTGTAGGGGATGGCGCT
GTTGTCGCGGAAGTTGACGGAAATGAATACGCTCTGGATGGCAGTATTACACAAACGAATACTGGCTCGGTTATTACCAAT
GAGGCAGATATCTCTTCGCCGCTGAATAATGCCAAGGGCTTTATTACGCGTAATCAGGGACTGTTGATTAACAACGGCAAC
ATTGATTTCACTACCGGTACAGATAATATCGGCGTCTGGGTTGATAACGGCCGCTTTGAAAATACAGGAAGCCGTATTGCG
GTCAATGGCGTTGCATTATTTGTTGAAGGTGCACAGTCTCAGATTACCAGCACAGGAGGGGATATCGTCGCTGTGGATGGT
GAGGCTGCCATTAAGCTGGGGGCGGGCGCGTCACTGAACCTGGCAGGGAGTGGCTTGGGTACGATCGAAGGTCAGAAAAAT
GCGCATGGCATCCTGCTGGATACAGGGGCTGTGGGGCTGGTTATTGATGGTGCGAAAATCAATGTTAATGCTGCAGGTGCG
GTCGGTCACGGGATTGAGAACCGCGCAGAAATTGAAGGCATTCAGTTAACCAATACGACTGAAATTAATGTCGCTGATGGC
ATTGGTGTACGTACTTCTGCCTCCCTGGCCAAGACCAACAGCGGCACTATTAATGTAGACGGCAGTGGAATTGCACTGGCG
TTCCAGAAAGCTGACGGAAGTGAAACCGATAATAACCTGGATATGTCTGACTCCGCTGGATTGGTCATTAACCTGAAGGGT
ACGGACGGCACGGGTATTTTCGCCAACACTAAAGATGGTGCTGTCGTGAAGAGTGGTGCAAGTGTCAATGTTATACAGGCC
GATGGCGGTTCCGCTCTGGTGGTTAACAATGCAGCCAGTGAAGTGGTTCAGAGCGGTAATCTCATCTCTGCTTCTCTGAGT
CATGCCGTAGTGGATGCTTCAAAACCACAATCCTTTACCAATAAAGGTCAGATTAAAGCTGCGTCCACCACCGGGACTGCA
ATGGCGTTTGATGACGCCGTGAATACCACCGTACTGAATGACGACGGTGCTGAAATTCAGGGGGTTGTGGCTCTGAACGGC
GGTGATAACACATTCACCAATAAAGGCAGTATTACCGGAACCGTCAGTGCGAAAGAGGGTAACAATACATTTTTATTTGAT
GATGGCAGCACACTGACAGGAGAAGTGACTGCAGGAAATGGCAATAATAATGTAACACTCAATGGTAAGACTCATGTTGAT
CAGGTTACTGCCGGTACCGGGAAGAACACCTTCACCATTAAAGGTGAAGGGGCAACCTGGAACCTGCTGGATGGCGGG
```

SEQ ID NO: 648
```
GERSVLFRIEDGAKQAGSLLMKTSGTGSRGIWATGKGSNVLADAGSDFQILGAQAQGLYVTGGATATLKQGASVNLVGDGA
VVAEVDGNEYALDGSITQTNTGSVITNEADISSPLNNAKGFITRNQGLLINNGNIDFTTGTDNIGVWVDNGRFENTGSRIA
VNGVALFVEGAQSQITSTGGDIVAVDGEAAIKLGAGASLNLAGSGLGTIEGQKNAHGILLDTGAVGLVIDGAKINVNAAGA
VGHGIENRAEIEGIQLTNTTEINVADGIGVRTSASLAKTNSGTINVDGSGIALAFQKADGSETDNNLDMSDSAGLVINLKG
TDGTGIFANTKDGAVVKSGASVNVIQADGGSALVVNNAASEVVQSGNLISASLSHAVVDASKAQSFTNKGQIKAASTTGTA
MAEDDAVNTTVLNDSGAEIQGVVALNGGDNTFTNKGSITGTVSAKEGNNTFLFDDGSTLTGEVTAGNGNNNVTLNGKTHVD
QVTAGTGKNTFTIKGEGATWNLLDGG
```

SEQ ID NO: 649
```
CAGGGAGATTCTGATTCCCTGATTTTTGATAACGCCATTCATACGCTGGATTCTGTTGTAAAACTACAGAATTTCGAACAT
GTCGGGCTGAAGAACAGTTCACTTGTCACTCTGAAGGAAGCTCTTTGTGCTGACCGATGGGGGGAACGGTCCGGGTTCCGTC
GATATTGAATCGGGCACCGAACTGGCCATTATTCCCGCAGTTGCAGGCAACTTTACCTTTGATCCACTGTTAACAGGCAAA
GGAACACTGTCTGCCCGTCTTGATGCCGACACATCTGCTTTTGAATTCAGCCATAACGTCGGGGATCAATTTGCCGGAACT
CTGAAGCTGGGGTACTAGTAGCTTTGCTCTGGAAGGGCTGAATACGAGCGGGTTAACCCATGCAATGCTGATGTCTGAAACC
GGGAATATCACAACGGTTGGCTCCGGTGTTCAGCAGATTGGCGGTCTTGGGTTCAATGGCGGAACGCTGATTTTTGGTTCC
GTTATGCCGGGCGATACCATTGCCAGCAACAGTATTGAAACCTCTGCTGCAGGTACGCTGGATATCCGGGGGGAAAGGCACA
ATTCAGGTCACCATGCCAGATGAAGTGATTAATGATATTCCGGCTGTTGATACCCGTAAGAATTTGCTGGAGCAGGATGAT
GCGCAGACCCTGGTCACGCTGGTGAATGCAGCGGGTACCGTCACCGGTACTGGCGCGCAACTGCAACTGGTGGATGAAAAC
GGGCAGGCTATTTCTCACAGTCAGACGTTTGATGTCACTCAGGGCGGTGAAGTTGTAGCTCAGGGAAATTATGACTATAAG
CTGCTGGGAAGCTCCGACGGTATTAAAGGTGACGGACTGTATCATAGGCTATGGGCGTGAAGTCGCTGGATTTACAGGGAACC
GGTGATAAAGCGCTGGTGCTGACACCGAGAGCGAATGCCCAGGGACTGCAGACAGATCTTGGCGCACAGTTAACGGGGGCA
GGGGATCTGGCCATCGAAGCTGCGGGGCAGGTTGTCACACTGTCTAACGGCGGTAATAACTACACCGGGGATACGCTGGTG
CGCAGCGGCACATTACAGATGGCAAATGATAATGTACTTGGCGCAACAGGTAATCTGAACGTCGCCAGCAATGCCGTCTTC
AGAACAAAC
```

SEQ ID NO: 650
```
QGDSDSLIFDNAIHTLDSVVKLQNFEHVGLKNSSLVTLKEALVLTDGGNGPGSVDIESGSELAIIPAVAGNFTFDPLLTGK
GTLSARLDADTSAFEFSHNVGDQFAGTLKLGTSSFALEGLNTSGLTHAMLMSETGNITTVGSGVQQIGGLGFNGGTLIFGS
VMPGDTIASNSIETSAAGTLDIRGKGTIQVTMPDEVINDIPAVDTRKNLLEQDDAQTLVTLVNAAGTVTGTGGQLQLVDEN
GQAISHSQTFDVTQGGEVVAQGNYDYKLLGSSDGIKGDGLYIGYGLKSLDLQGTGDKALVLTPRANAQGLQTDLGAQLTGA
GDLAIEAAGQVVTLSNGGNNYTGDTLVRSGTLQMANDNVLGATGNLNVASNAVFRTN
```

SEQ ID NO: 651
```
GCTGACACGGTTGTACAGGCGGGAGAAACCGTGAACGGCGGAACACTGACAAATCATGACAACCAGATTGTCCTCGGTACG
GCCAACGGAATGACCATCAGTACCGGGCTGGAGTATGGGCCGGATAACGAGGCCAATACCGGCGGGCAATGGATACAAAAT
GGCGGTATCGCCAACAACACTACTGTCACCGGTGGTGCTTGAGAGAGTGAATGCCGAGGAAGCGTTTCAGACACGGTT
ATCAGTGCCGGAGGCGGACAGAGCCTTCAGGGGCAGGCAGTGAACACCACTCTGAACGGCGGTGAGCAGTGGGTACATGAA
GGCGGGATTGCAACGGGTACCGTCATTAATGAGAAGGGCTGGCAGGCCGTCAAATCCGGTGCAATGGCAACCGACACGGTT
GTGAATACCGGCGCGGAAGGAGGACCGGATGCGGAAAATGGTGATACCGGGCAGACCGTCTACGGAGATGCCGTACGCACC
ACCATCAATAAAAATGGTCGTCAGATTGTGGCTGCTGAAGGAACGGCAAATACCACTGTGGTTTATGCCGGCGGCGACCAG
ACTGTACATGGTCACGCACTGGATACCACGCTGAATGGGGGGTACCAGTATGTGCACAACGGAGGTACAGCATCTGACACT
GTTGTTAACAGTGACGGCTGGCAGATTATCAAGGAAGGTGGTCTGGCGGATTTCACCACCGTTAACCAGAAAGGTAAACTG
CAGGTGAACGCCGGTGGTACAGCCACGAATGTCACCCTGACGCAGGGCGGCGCACTGGTCACCAGTACGGCCGCAACCGTC
ACCGGCAGCAACCGTCTGGGCAATTTCACTGTGGAAAACGGTAATGCTGACCGTGTTGTTCTGGAGTCCGGTGGTCGCCTG
GATGTACTGGAGGGCCATTCAGCCTGGAAAACACTGGTGGATGACGGTACCCTGGCAGTGTCTGCCGGTGGTAAGGCA
ACAGATGTCACCATGACATCCGGTGGTGCCCTGATTGCAGACAGTGGTGCCACTGTTGAGGGGACCAATGCCAGCGGTAAG
TTCAGTATTGATGGCATATCCGGTCAGGCCAGCGGCCTGCTGCTGGAAAATGGCGGCAGCTTTACGGTTAATGCCGGAGGA
CTGGCCAGCAACACCACTGTCGGACATCGTGGAACACTGACGCTGGCCGCCGGGGGAAGTCTGAGTGGCAGAACACAGCTC
AGTAAAGGCGCAGTGGTAGTGAATGGTGATGTGGTCAGGCGATATTGTTAACGCCGGAGAGATTCGCTTTGAT
AATCAGACGACACCGGATGCCGCACTGAGCCGTGCTGTTGCAAAAGGCGACTCCCCGGTAACGTTCCATAAACTGACCACC
AGTAACCTCACCGGTCAGGGTGGCACCATCAATATGCGTGTTCGCCTTGATGGCAGCAATGCCTCTGACCAGCTGGTGATT
AATGGTGGTCAGGCAACCGGCAAAACCTCGCTTGCGTTTACAAATGTCGGAAACAGTAACCTCGGGGTGGCAACCTCCGGA
CAGGGTATCCGGGTTGTGGATGACACAGAATGGTGCCACCACAGAAGAAGGTGCGTTTGCCCTGAGTCGCCCGCTTCAGGCC
GGCGCCTTTAACTACACCCTGAACCGTGAGAGCGATGAAGACTGGTACCTGCGCAGTGAAAATGCTTATCGTGCTGAAGTC
CCC
```

SEQ ID NO: 652
```
ADTVVQAGETVNGGTLTNHDNQIVLGTANGMTISTGLEYGPDNEANTGGQWIQNGGIANNTTVTGGGLQRVNAGGSVSDTV
ISAGGGQSLQGQAVNTTLNGGEQWVHEGGIATGTVINEKGWQAVKSGAMATDTVVNTGAEGGPDAENGDTGQTVYGDAVRT
TINKNGRQIVAAEGTANTTVVYAGGDQTVHGHALDTTLNGGYQYVHNGGTASDTVVNSDGWQIIKEGGLADFTTVNQKGKL
QVNAGGTATNVTLTQGGALVTSTAATVTGSNRLGNFTVENGNADGVVLESGGRLDVLEGHSAWKTLVDDGGTLAVSAGGKA
TDVTMTSGGALIADSGATVEGTNASGKFSIDGISGQASGLLLENGGSFTVNAGGLASNTTVGHRGTLTLAAGGSLSGRTQL
```

-continued

SKGASMVLNGDVVSTGDIVNAGEIRFDNQTTPDAALSRAVAKGDSPVTFHKLTTSNLTGQGGTINMRVRLDGSNASDQLVI
NGGQATGKTWLAFTNVGNSNLGVATSGQGIRVVDAQNGATTEEGAFALSRPLQAGAFNYTLNRDSDEDWYLRSENAYRAEV
P

SEQ ID NO: 677

```
TGCGTGGCGTGGGCAAATATCTCTGTTCAGGTTCTTTTTCCACTCGCTGTCACCTTTACGCCAGTAATGGCAGCACGTGCG
CAGCCATGCGGTTCAGCCACGGTTGAGCATGGAAAATACTACGGTAACTGCTGATAATAACGTGGAGAAAAATGTCGCGTCG
CTTGCCGCTAATGCCGGGACATTTTTAAGCAGTCAGCCAGATAGCGATGCGACACGTAACTTTATTACCGGAATGGCCACC
GCTAAAGCTAACCAGGAAATTCAGGAGTGGCTCGGGAAATACGGTACTGCGCGCGTCAAACTGAATGTCGATAAAAATTTC
TCGCTGAAGGACTCTTCGCTGGAAATGCTTTATCCGATTTATGATACACCGACAAATATGTTGTTCACTCAGGGGGCAATA
CATCGTACCGACGATCGTACTCAGTCAAATATTGGTTTTGGCTGGCGTCATTTTTCAGAAAATGACTGGATGGCGGGGGTG
AATACTTTTATCGATCATGATTTATCCCGTAGTCATACCCGCATTGGTGTTGGTGCGGAATACTGGCGTGATTATTTGAAA
CTGAGCGCCAATGGTTATATCCGGGCTTCTGGCTGGAAAAAATCGCCGGATGTTGAGGATTATCAGGAACGCCCGGCGAAT
GGCTGGGATATTCGTGCTGAGGGCTATTTACCTGCCTGGCCGCAGCTTGGCGCAAGCCTGATGTATGAACAGTATTATGGC
GATGAAGTCGGGCTGTTTGGTAAAGATAAACGCCAGAAAGATCCACATGCGATTACCGCTGAAGTGAATTACACGCCAGTG
CCTCTTCTGACCCTGAGTGCCGGGCATAAGCAGGGCAAGAGTGGTGAGAATGACACTCGCTTTGGCCTGGAAGTTAATTAT
CGGATTGGCGAACCTCTGGAAAAACAACTCGATACAGACAGCATTCGCGAGCGTCGAATGCTGGCAGGCAGCCGCTATGAC
CTGGTTGAGCGTAATAACAATATCGTTCTTGAGiATCGCAAATCTGAAGTGATCCGTATTGCTTCTGCCTGAGCGTATTGAA
GGCAAGGGCGGCCAGACGGTTTCCCTGGGGCTTGTGGTCAGCAAAGCAACTCACGGTCTGAAAAATGTGCAATGGGAAGCG
CCGTCTTTGCTGGCCGCAGGCGGAAAAATTACGGGGCAGGGCAATCAGTGGCAAGTGACGCTCCCGGCTTATCAGGCAGGC
AAAGACAATTATTATGCGATTTCAGCGATTGCCTACGATAACAAAGGCAATGCCTCGAAACGTGTGCAGACAGAAGTAGTT
ATTAGCGGAGCTGGTATGAGCGCCGATCGTACGACGTTAACGCTTGACGGTCAGAGCCGTATTCAAATGCTTGCTAACGGT
AATGAGCAAAAGCCGCTGGTGCTGTCTCTGCGCGACGCCGAGGGCCAGCCAGTCACGGGCATGAAAGATCAGATCAAGACT
GAACTAACCTTCAAACCGGCTGGAAATATTGTGACTCGTACCCTGAAGGCCACTAAATCACAGGCAAAGCCAACACTGGGT
GAGTTCACCGAAACTGAAGCAGGGGTGTATCAGTCTGTCTTTACTACCGGAACGCAGTCAGGTGAGGCAACGATTACTGTT
AGCGTTGATGACATGAGCAAAACTGTCACTGCAGAACTGCGGGCCACGATGATGGATGTGTCAAACTCCACCCTGAGTGCT
AACGAGCCGTCAGGTGATGTGGTTGCTGATGGTCAGCAAGCCTACACGCTGACACTGACAGCGGTGGACTCCGAGGGTAAT
CCGGTGACGGGAGAAGCCAGCCGCCTGCGACTTGTTCCGCAAGCACTAATGGTGTAACCGTTGGTGCCATTTCGGAAATA
AAACCAGGGGTTTACAGCGCCACGGTTTCTTCGACCCGTGCCGGAAACGTTGTTGTGCGTGCCTTCAGCGAGCAGTATCAG
CTGGGCACATTACAACAAACGCTGAAGTTTGTTGCCGGGCCGCTTGATGCAGCACATTCGTCCATCACACTGAATCCTGAT
AAACCGGTGGTTGGCGGTACAGTTACGGCAATCTGGACGGCAAAAGATGCTAATGACAACCCTGTAACTGGCCTCAATCCG
GATGCACCGTCATTATCGGGCGCAGCTGCTGCTGGTTCTACGGCATCAGGCTGGACGGATAATGGCGACGGGACCTGGACT
GCGCAGATTTCTCTCGGCACTACGGCGGGTGAATTAGACGTTATGCCGAAGCTCAATGGGCAGGACGCGGCAGCAAATGCG
GCAAAAGTAACCGTGGTGGCTGATGCATTATCTTCAAACCAGTCGAAAGTCTCTGTCGCAGAAGATCACGTAAAAGCCGGT
GAAAGCACAACCGTAACGCTGGTGGCGAAAGATGCGCATGGCAACGCTATCAGTGGTCTTTCGTTGTCGGCAAGTTTGACG
GGGACCGCCTCTGAAGGGGCGACCGTTTCCAGTTGGACCGAAAAAGGTGACGGTTCCTATGTTGCTACGTTAACTACAGGC
GGAAAGACGGGCGAGCTTCGTGTCATGCCGCTCTTCAACGGCCAGCCTGCAGCCACCGAAGCCGCGCAGCTGACTGTTATT
GCCGGAGAGATGTCATCAGCGAACTCTACGCTTGTTGCGGACAATAAAACTCCAACGGTTAAAACGACGACGGAACTCACC
TTCACCATGAAGGATGCGTACGGGAATCCGGTCACCGGGCTGAAGCCAGATGCACCAGTGTTTAGTGGTGCCGCCAGCACG
GGGAGTGAGCGTCCTTCAGCAGGAAACTGGACAGAGAAAGGTAATGGGGTCTACGTGTCGACCTTAACGCTGGGATCTGCC
GCGGGTCAGTTGTCTGTGATGCCGCGAGTGAACGGCCAAAATGCCGTTGCTCAGCCACTGGTGCTGAATGTTGCAGGTGAC
GCATCTAAGGCTGAGATTCGTGATATGACAGTGAAGGTTAATAACCAA
```

SEQ ID NO: 678

```
CTGGCTAATGGACAGTCTGCTAACCAGATCACCCTGACCGTCGTGGACAGCTATGGTAACCCGTTGCAGGGGCAAGAAGTT
ACGCTGACTTTACCGCAGGGTGTGACCAGCAAGACGGGGAATACAGTAACAACCAATGCGGCAGGGAAAGTGGACATTGAG
CTTATGTCAACGGTTGCAGGGGAACTTGAGATCGAGGCCTCGGTGAAAAACTCTCAGAAGACGGTCAAGGTGAAATTCAAG
GCGGATTTCAGTACCGGTCAGGCGAGCCTGGAGGTAGACGCCGCTGCTCAAAAAGTGGCAAACGGCAAAGATGCCTTTACG
CTGACGGCAACGGTTAAGGATCAATACGGCAACCTTCTTCCTGGCGCTGTGGTCGTCTTTAATCTGCCTCGGGGCGTCAAA
CCGCTTGCAGACGGTAATATCATGGTGAACGCCGACAAGGAGGGTAAAGCGGAACTGAAAGTGGTTTCCGTGACTGCCGGA
ACCTATGAGATCACGGCGTCAGCAGGAAATGACCAGCCTTCGAATGCGCAGTCTGTAACGTTTGTGGCTGATAAGACTACG
GCGACCATCTCCAGTATTGAGGTGATTGGCAACCGTGCAGTGGCGGACGGCAAAACCAAACAGACGTATAAAGTTACGGTG
ACTGATGCCAATAACAACCTGCTGAAAGATAGCGAAGTGACGCTGACTGCCAGCCCGGAAAATTTAGTTCTGACTCCCAAT
GGGACGGCGACAACGAATGAGCAAGGGCAGGCTATTTTCACCGCCACGACCACTGTCGCAGCGACATATACACTCACGGCG
AAAGTGGAACAGGCCGACGGTCAGGAATCGACGAAAACTGCCGAATCTAAATTCGTCGCGGATGATAAAAACGCGGTCGCTC
GCTGCATCTCCAGAGCGTGTAGATTCTCTGGTGGCGGACGGGAAGACTACTGCAACACTGACGGTTACTCTGATGTCGGGT
GTCAACCCCGTAGGAGGAACCATGTGGGTCGACATTGAGGCTCCGGAAGGGGTGACAGAGGCGGATTATCAGTTCCTGCCG
TCGAAAAATGACCATTTCGCGAGCGGGAAAATCACGCGTACATTTAGTACCAACAAGCCAGGTACATACACATTCACATTC
AACTCTTTGACATATGGAGGGTATGAAATGAAACCAGTGACTGTGACAATTAACGCCGTTCCTGCAGATACTGAAGGCGCT
GAGGAGAAA
```

SEQ ID NO: 679

```
GAGGGTCAGAGCCGTATTCAAATGCTTGCTAACGGTAATGAGCAAAAGCCGCTGGTGCTGTCTCTGCGCGACGCCGAGGGC
CAGCCAGTCACGGGCATGAAAGATCAGATCAAGACTGAACTAACCTTCAAACCGGCTGGAAATATTGTGACTCGTACCCTG
AAGGCCACTAAATCACAGGCAAAGCCAACACTGGGTGAGTTCACCGAAACTGAAGGAGGGGTGTATCAGTCTGTCTTTACT
ACCGGAACGCAGTCAGGTGAGGCAACGATTACTGTTAGCGTTGATGACATGAGCAAAACTGTCACTGCAGAACTGCGGGCC
ACGATGATGGATGTGTCAAACTCCACCCTGAGTGCTAACGAGCCGTCAGGTGATGTGGTTGCTGATGGTCAGCAAGCCTAC
ACGCTGACACTGACAGCGGTGGACTCCGAGGGTAATCCGGTGACGGGAGAAGCCAGCCGCCTGCGACTGTTCCGCARGAC
ACTAATGGTGTAACCGTTGGTGCCATTTCGGAAATAAAACCAGGGGTTTACAGCGCCACGGTTTCTTCGACCCGTGCCGGA
AACGTTGTTGTGCGTGCCTTCAGCGAGGAGTATCAGCTGGGCACATTACAACAAACGCTGAAGTTTGTTGCCGGGCCGCTT
GATGCAGCACATTCGTCCATCACACTGAATCCTGATAAACCGGTGGTTGGCGGTACAGTTACGGCAATCTGGACGGCAAAA
GATGCTAATGACAACCCTGTAACTGGCCTCAATCCGGATGCACCGTCATTATCGGGCGCAGCTGCTGCTGGTTCTACGGCA
TCAGGCTGGACGGATAATGGCGACGGGACCTGGACTGCGCAGATTTCTCTCGGCACTACGGCGGGTGAATTAGACGTTATG
CCGAAGCTCAATGGGCAGGACGCGGCAGCAAATGCGGCAAAAGTAACCGTGGTGGCTGATGCATTATCTTCAAACCAGTCG
AAAGTCTCTGTCGCAGAAGATCACGTAAAAGCCGGTGAAAGCACAACCGTAACGCTGGTGGCGAAAGATGCGCATGGCAAC
GCTATCAGTGGTCTTTCGTTGTCGCAAGTTTGACGGGGACCGCCTCTGAAGGGGCGACCGTTTCCAGTTGGACCGAAAAAG
GTGACGGTTCCTATGTTGCTACGTTAACTACAGGCGGAAAGCGGGCGAGCTTCGTGTCATGCCGCTCTTCAACGGCCAG
CCTGCAGCCACCGAAGCCGCGCAGCTGACTGTTATTGCCGGAGAGATGTCATCAGCGAACTCTACGCTTGTTGCGGACAAT
AAAACTCCAACGGTTAAAACGACGACGGAACTCACCTTCACCATGAAGGATGCGTACGGGAATCCGGTCACCGGGCTGAAG
CCAGATGCACCAGTGTTTAGTGGTGCCGCCAGCACGGGGAGTGAGCGTCCTTCAGCAGGAAACTGGACAGAGAAAGGTAAT
GGGGTCTACGTGTCGACCTTAACGCTGGGATCTGCCGCGGGTCAGTTGTCTGTGATGCCGCGAGTGAACGGCCAAAATGCC
```

-continued

```
GTTGCTCAGCCACTGGTGCTGAATGTTGCAGGTGACGCATCTAAGGCTGAGATTCGTGATATGACAGTGAAGGTTAATAAC
CAACTGGCTAATGGACAGTCTGCTAACCAGATCACCCTGACCGTCGTGGACAGCTATGGTAACCCGTTGCAGGGGCAAGAA
GTTACGCTGACTTTACCGCAGGGTGTGACCAGCAAGACGGGGAATACAGTAACAACCAATGCGGCAGGGAAAGTGGACATT
GAGCTTATGTCAACGGTTGCAGGGGAACTTGAGATCGAGGCCTCGGTGAAAAACTCTCAGAAGACGGTCAAGGTGAAATTC
AAGGCGGATTTCAGTACCGGTCAGGCGAGCCTGGAGGTAGAGCCGCTGCTCAAAAAGTGGCAAACGGCAAAGATGCCTTT
ACGCTGACGGCAACGGTTAAGGATCAATACGGCAACCTTCTTCCTGGCGCTGTGGTCGTCTTTAATCTGCCTCGGGGCGTC
AAACCGCTTGCAGACGGTAATATCATGGTGAACGCCGACAAGGAGGGTAAAGCGGAACTGAAAGTGGTTTCCGTGACTGCC
GGAACCTATGAGATCACGGCGTCAGCAGGAAATGACCAGCCTTCGAATGCGCAGTCTGTAACGTTTGTGGCTGATAAGACT
ACGGCGACCATCTCCAGTATTGAGGTGATTGGCGAACCGTGCAGTGGCGGACGGCAAAACCAAACAGACGTATAAAGTTACG
GTGACTGATGCCAATAACAACCTGCTGAAAGATAGCGAAGTGACGCTGACTGCCAGCCCGGAAAATTTAGTTCTGACTCCC
AATGGGACGGCGACAACGAATGAGCAAGGGCAGGCTATTTTCACCGCCACGACCACTGTCGCAGCGACATATACACTCACG
GCGAAAGTGGAACAGGCCGACGGTCAGGAATCGACGAAAACTGCCGAATCTAAATTCGTCGCGGATGATAAAAACGCGGTG
CTCGCTGCATCTCCAGAGCGTGTAGATTCTCGGTGGCGGACGGGAAGACTACTGCAACACTGACGGTTACTCTGATGTCG
GGTGTCAACCCCGTAGGAGGAACCATGTGGGTCGACATTGAGGCTCGCGGAAGGGGTGACAGAGGCGGATTATCAGTTCCTG
CCGTCGAAAAATGACCATTTCGCGAGCGGGAAAATCACGCGTACATTTAGTACCAACAAGCCAGGTACATACACATTCACA
TTCAACTCTTTGACATATGGAGGGTATGAAATGAAACCAGTGACTGTGACAATTAACGCCGTTCCTGCAGATACTGAAGGC
GCTGAGGAGAAA
```

SEQ ID NO: 680

```
CVAWANTSVQVLFPLAVITTPVMAARAQHAVQPRLSMENTTTIADNNVEKNVASLAANAGTELSSQPDSDATRNFITGMAT
AKANQEIQEWLGKYGTARVKLNVDKNEELKDSSLEMLYPIYDTPTNMLFTQGAIHRTDDRTQSNIGFGWRHFSENDWMAGV
NTFIDHDLSRSHTRIGVGAEYWRDYLKLSANGYIRASGWRKSPDVEDYQERPANGWDIRAEGYLPAWPQLGASLMYEQYYG
DEVGLFGKDKRQKDPHAITAEVNYTPVPLLTLSAGHKQGKSGENDTRFGLEVNYRIGEPLEKQLDTDSIRERRMLAGSRYD
LVERNNNIVLEYRKSEVIRIALPERIEGKGGQTVSLGLVVSKATHGLKNVQWEAPSLLAAGGKITGQGNQWQVTLPAYQAG
KDNYYAISAIAYDNKGNASKRVQTEVVISGAGMSADRTALTLDGQSRIQMLANGNEQKPLVLSLRDAEGQPVTGMKDQIKT
ELTFKPAGNIVTRTLKATKSQAKPTLGEFTETEAGVYQSVFTTGTQSGEATITVSVDDMSKTVTAELRATMMDVSNSTLSA
NERSGDVVADGQQAYTLTLTAVDSEGNPVTGEASRLRLVPQDTNGVTVGAISEIKPGVYSATVSSTRAGNVVVRAFSEQYQ
LGTLQQTLKFVAGPLDAARSSITLNPDKPVVGGTVTAIWTAKDANDNPVTGLNPDAPSLSGAAAAGSTASGWTDNGDGTWT
AQIELGTTAGELDVMPKLNGQDAAANAAKVTVVADALSSNQSKVSVAEDHVKAGESTTVTLVAKDAHGNAISGLSLEASET
GTASEGATVSSWTEKGDGSYVATLTTGGKTGELRVMPLENGQPAATEAAQLTVIAGEMSSANSTLVADNKTPTVKTTTELT
FTMKDAYGNPVTGLKPDAPVFSGAASTGSERPSAGNWTEKGNGVYVSTLTLGSAAGQLSVMPRVNGQNAVAQPLVLNVAGD
ASKAEIRDMTVKVNNQ
```

SEQ ID NO: 681

```
LANGQSANQITLTVVDSYGNPLQGQEVTLTLPQGVTSKTGNTVTTNAAGKVDIELMSTVAGELEIEASVKNSQKTVKVKFK
ADFSTGQASLEVDAAAQKVANGKDAFTLTATVKDQYGNLLPGAVVVFNLPRGVKPLADGNIMVNADKEGKAELKVVSVTAG
TYEITASAGNDQPSNAQSVTFVADKTTATISSIEVIGNRAVADGKTKQTYKVTVTDANNNLLKDSEVTLTASPENLVLTPN
GTATTNEQGQAIETATTTVAATYTLTAKVEQADGQESTKTAESKFVADDKNAVLAASPERVDSLVADGKTTATLTVTLMSG
VNPVGGTMWVDIEAPEGVTEADYQFLPSKNDHFASGKITRTFSTNKPGTYTFTFNSLTYGGYEMKPVTVTINAVPADTEGA
EEK
```

SEQ ID NO: 682

```
DGQSRIQMLANGNEQKPLVLSLRDAEGQPVTGMKDQIKTELTFKPAGNIVTRTLKATKSQAKPTLGEFTETEAGVYQSVFT
TGTQSGEATITVSVDDMSKTVTAELRATMMDVSNSTLSANEPSGDVVADGQQAYTLTLTAVDSEGNPVTGEASRLRLVPQD
TNGVTVGAISEIKPGVYSATVSSTRAGNVVVRAFSEQYQLGTLQQTLKFVAGPLDAAHSSITLNPDKPVVGGTVTAIWTAK
DANDNPVTGLNPDAPSLSGAAAAGSTASGWTDNGDGTWTAQISLGTTAGELDVMPKLNGQDAAANAAKVTVVADALSSNQS
KVSVAEDHVKAGESTTVTLVAKDAHGNAISGLSLSASLTGTASEGATVSSWTEKGDGSYVATLTTGGKTGELRVMPLFNGQ
PAATEAAQLTVIAGEMSSANSTLVADNKTPTVKTTTELTFTMKDAYGNPVTGLKPDAPVFSGAASTGSERPSAGNWTEKGN
GVYVSTLTLGSAAGQLSVMPRVNGQNAVAQPLVLNVAGDASKAEIRDMTVKVNNQLANGQSANQITLTVVDSYGNPLQGQE
VTLTLPQGVTSKTGNTVTTNAAGKVDIELMSTVAGELEIEASVKNSQKTVKVKFKADFSTGQASLEVDAAAQKVANGKDAF
TLTATVKDQYGNLLPGAVVVFNLPRGVKPLADGNIMVNADKEGKAELKVVSVTAGTYETTASAGNDQPSNAQSVTFVADKT
TATISSIEVIGNRAVADGKTKQTYKVTVTDANNNLLKDSEVTLTASPENLVLTPNGTATTNEQGQAIFTATTTVAATYTLT
AKVEQADGQESTKTAESKEVADDKNAVLAASPERVDSLVADGKTTATLTVTLMSGVNPVGGTMWVDIEAPEGVTEADYQFL
PSKNDHFASGKITRITSTNKPGTYTFTFNSLTYGGYEMKPVTVTINAVPADTEGAEEK
```

SEQUENCE LISTING (685 sequences)

SEQ ID NO: 1 - protein, 162 aa, Escherichia coli
MLKMSLYVIILLFSLQFSAAITGKESEVVSPLLMDVNPSLTMENISELSTSSEPSQQGVFPVICTRLHPGSVMKRQLLTGWGPVFIIGDDPFSLRWMSEHLEILKSLNALGLVVNVESVERMEVLQQRADGLLLLPVICDNFVQALQLNAYPVLITEMEISQ

SEQ ID NO: 2 - protein, 162 aa, Escherichia coli
MLKISLYVIILLFSFQISAAITSKESEVVSPLLMDVNSSLTMENISELSTSSEPSQQGVFPVICTRLHPGSVMKRQLLTGWGPVFIIGDDPFSLRWMSEHLEILKSLNALGLVVNVESVERMEVLQQRADGLLLLPVICDNFVQTLQLNAYPVLITEMEISQ

SEQ ID NO: 3 - protein, 1418 aa, Escherichia coli
MSHYKTGHKQPRFRYSVLARCVAWANISVQVLFPLAVTFTPVMAARAQHAVQPRLSMGNTTVTADNNVEKNVASFAANAGTFLSSQPDSDATRNFITGMATAKANQEIQEWLGKYGTARVKLNVDKDFSLKDSSLEMLYPIYDTPTNMLFTQGAIHRTDDRTQSNIGFGWRHFSGNDWMAGVNTFIDHDLSRSHTRIGVGAEYWRDYLKLSANGYIRASGWKKSPDVEDYQERPANGWDIRAEGYLPAWPQLGASLMYEQYYGDEVGLFGKDKRQKDPHAISAEVTYTPVPLLTLSAGHKQGKSGENDTRFGLEVNYRIGEPLAKQLDTDSIRERRVLAGSRYDLVERNNNIVLEYRKSEVIRIALPERIEGKGGQTLSLGLVVSKATHGLKNVQWEAPSLLAEGGKITGQGSQWQVTLPAYRPGKDNYYAISAVAYDNKGNASKRVQTEVVITGAGMSADRTALTLDGQSRIQMLANGNEQRPLVLSLRDAEGQPVTGMKDQIKTELAFKPAGNIVTRSLKATKSQAKPTLGEFTETEAGVYQSVFTTGTQSGEATITVSVDGMSKTVTAELRATMMDVANSTLSANEPSGDVVADGQQAYTLTLTAVDSEGNPVTGEASRLRFVPQDTNGVTVGAISEIKPGVYSATVSSTRAGNVVVRAFSEQYQLGTLQQTLKFVAGPLDAAHSSITLNPDKPVVGGTVTAIWTAKDAYDNPVTSLTPEAPSLAGAAAVGSTASGWTNNGDGTWTAQITLGSTAGELEVMPKLNGQDAAANAAKVTVVADALSSNQSKVSVAEDHVKAGESTTVTLIAKDAHGNTISGLSLSASLTGTASEGATVSSWTEKGDGSYVATLTTGGKTGELRVMPLFNGQPAATEAAQLTVIAGEMSSANSTLVAANKAPTVKMTTELTFTVKDAYGNPVTGLKPDAPVFSGAASTGSERPSAGNWTEKGNGVYVATLTLGSAAGQLSVMPRVNGQNAVAQPLVLNVAGDASKAEIRDMTVKVNNQLANGQSANQITLTVVDSYGNPLQGQEVTLTLPQGVTSKTGNTVTTNAAGKVDIELMSTVAGEHSITASVNNAQKTVTVKFKADFSTGQATLEVDGSTPKVANDNDAFTLTATVKDQYGNLLPGAVVVFNLPWGVKPLADGNIMVNADKEGKAELKVVSVTAGTYEITVSAGNDQPSNAQSVTFVADKTTATISSIEVIGNRAVADGKTKQTYKVTVTDANNNLLKDSDVTLTASSENLVLDPKGTAKTNEQGQAVFTGSTTIAATYTLTAKVEQANGQVSTKTAESKFVADDKNAVLAASPERVDSLVADGKTTATMTVTLMAGVNPVGGSMWVDIEAPEGVTEKDYQFLPSKADHFSGGKITRTFSTSKPGVYTFTFNALTYGGYEMTPVKVTINAVAAETENGEEEMP

SEQ ID NO: 4 - protein, 1418 aa, Escherichia coli
MSHYKTGHKQPRFRYSVLARCVAWANISVQVLFPLAVTFTPVMAARAQHAVQPRLSMGNTTVTADNNVEKNVASFAANAGTFLSSQPDSDATRNFITGMATAKANQEIQEWLGKYGTARVKLNVDKDFSLKDSSLEMLYPIYDTPTNMLFTQGAIHRTDDRTQSNIGFGWRHFSGNDWMAGVNTFIDHDLSRSHTRIGVGAEYWRDYLKLSANGYIRASGWKKSPDIEDYQERPANGWDIRAEGYLPAWPQLGASLMYEQYYGDEVGLFGKDKRQKDPHAISAEVTYTPVPLLTLSAGHKQGKSGENDTRFGLEVNYRIGEPLAKQLDTDSIRERRVLAGSRYDLVERNNNIVLEYRKSEVIRIALPERIEGKGGQTLSLGLVVSKATHGLKNVQWEAPSLLAEGGKITGQGSQWQVTLPAYRPGKDNYYAISAVAYDNKGNASKRVQTEVVITGAGMSADRTALTLDGQSRIQMLANGNEQRPLVLSLRDAEGQPVTGMKDQIKTELAFKPAGNIVTRSLKATKSQAKPTLGEFTETEAGVYQSVFTTGTQSGEATITVSVDGMSKTVTAELRATMMDVANSTLSANEPSGDVVADGQQAYTLTLTAVDSEGNPVTGEASRLRFVPQDTNGVTVGAISEIKPGVYSATVSSTRAGNVVVRAFSEQYQLGTLQQTLKFVAGPLDAAHSSIPLNPDKPVVGGTVTAIWTAKDAYDNPVTSLTPEAPSLAGAAAVGSTASGWTNNGDGTWTAQITLGSTAGELEVMPKLNGQDAAANAAKVTVVADALSSNQSKVSVAEDHVKAGESTTVTLIAKDAHGNTISGLSLSASLTGTASEGATVSSWTEKGDCSYVATLTTGGKTGELRVMPLFNGQPAATEAAQLTVIAGEMSSANSTLVADNKAPTVKMTTELTFTVKDAYGNPVTGLKPDAPVFSGAASTGSERPSAGNWTEKGNGVYVATLTLGSAAGQLSVMPRVNGQNAVAQPLVLNVAGDASKAEIRDMTVKVNNQLANGQSANQITLTVVDSYGNPLQGQEVTLTLPQGVTSKTGNTVTTNAAGKVDIELMSTVAGEHSITASVNNAQKTVTVKFKADFSTGQATLEVDGSTPKVANDNDAFTLTATVKDQYGNLLPGAVVVFNLPRGVKPLADGNIMVNADKEGKAELKVVSVTAGTYEITASAGNDQPSNAQSVTFVADKTTATISSIEVIGNRAVADGKTKQTYKVTVTDANNNLLKDSDVTLTASSENLVLDPKGTAKTNEQGQAVFTGSTTIAATYTLTAKVEQANGQVSTKTAESKFVADDKNAVLAASPERVDSLVADGKTTATMTVTLMAGVNPVGGSMWVDIEAPEGVTEKDYQFLPSKADHFSGGKITRTFSTSKPGVYTFTFNALTYGGYEMTPVKVTINAVAAETENGEEEMP

SEQ ID NO: 5 - protein, 1418 aa, Escherichia coli
MSHYKTGHKQPRFRYSVLARCVAWANISVQVLFPLAVTFTPVMAARAQHAVQPRLSMGNTTVTADNNVEKNVASFAANAGTFLSSQPDSDATRNFITGMATAKANQEIQEWLGKYGTARVKLNVDKDFSLKDSSLEMLYPIYDTPTNMLFTQGAIHRTDDRTQSNIGFGWRHFSGNDWMAGVNTFIDHDLSRSHTRIGVGAEYWRDYLKLSANGYIRASGWKKSPDVEDYQERPANGWDIRAEGYLPAWPQLGASLMYEQYYGDEVGLFGKDKRQKDPHAISAEVTYTPVPLLTLSAGHKQGKSGENDTRFGLEVNYRIGEPLAKQLDTDSIRERRVLAGSRYDLVERNNNIVLEYRKSEVIRIALPERIEGKGGQTLSLGLVVSKATHGLKNVQWEAPSLLAEGGKITGQGSQWQVTLPAYRPGKDNYYAISAVAYDNKGNASKRVQTEVVITGAGMSADRTALTLDGQSRIQMLANGNEQKPLVLSLRDAEGQPVTGMKDQIKTELTFKPAGNIVTRTLKATKSQAKPTLGEFTETEAGVYQSVFTTGTQSGEATITVSVDGMSKTVTAELRATMMDVANSTLSANEPSGDVVADGQQAYTLTLTAVDSEGNPVTGEASRLRFVPQDTNGVTVGAISEIKPGVYSATVSSTRAGNVVVRAFSEQYQLGTLQQTLKFVAGPLDAAHSSITLNPDKPVVGGTVTAIWTAKDANDNPVTGLNPDAPSLSGAAAVGSTASGWTDNGDGTWTAQISLGTTAGELEVMPKLNGQDAAANAAKVTVVADALSSNQSKVSVAEDHVKAGESTTVTLVAKDAHGNAISGLSLSASLTGTASEGATVSSWTEKGDGSYVATLTTGGKTGELRVMPLFNGQPAATEAAQLTVIAGEMSSANSTLVADNKAPTVKTTTELTFTVKDAYGNPVTGMKPDAPVFSGAANTGSERPSAGNWTEKGNGVYVATLTLGSAAGQLSVMPRVNGQNAVAQPLVLNVAGDASKAEIRDMTVKVNNQLANGQSANQITLTVVDSYGNPLQGQEVTLTLPQGVTSKTGNTVTTNAAGKVDIELMSTVAGEHSITASVNNAQKTVTVKFKADFSTGQATLEVDGSTPKVANDNDAFTLTATVKDQYGNLLPGAVVVFNLPRGVKPLADGNIMVNADKEGKAELKVVSVTAGTYEITASAGNDQPSNAQSVTFVADKTTATISSIEVIGNRAVADGKTKQTYKVTVTDANNNLLKDSDVTLTASSENLVLDPKGTAKTNEQGQAVFTGSTTIAATYTLTAKVEQANGQVSTKTAESKFVADDKNAVLAASPERVDSLVADGKTTATMTVTLMAGVNPVGGSMWVDIEAPEGVTEKDYQFLPSKADHFSGGKITRTFSTSKPGVYTFTFNALTYGGYEMTPVKVTINAVAAETENGEEEMP

SEQ ID NO: 6 - protein, 1415 aa, Escherichia coli
MSRYKTDNKQPRFRYSVLARCVAWANISVQVLFPLAVTFTPVMAARAQHAVQPRLSMENTTVTADNNVEKNVASLAANAGTFLSSQPDSDATRNFITGMATAKANQEIQEWLGKYGTARVKLNVDKNFSLKDSSLEMLYPIYDTPTNMLFTQGAIHRTDDRTQSNIGFGWRHFSENDWMAGVNTFIDHDLSRSHTRIGVGAEYWRDYLKLSANGYIRASGWKTSPDVEDYQERPANGWDIRAEGYLPAWPQLGASLMYEQYYGDEVGLFGKDKRQKDPHAITAEVNYTPVPLLTLSAGHKQGKSGENDTRFGLEVNYRIGEPLEKQLDTDSIRERRMLAGSRYDLVERNNNIVLEYRKSEVIRIALPERIEGKGGQTVSLGLVVSKATHGLKNVQWEAPSLLAAGGKITGQGNQWQVTLPAYQAGKDNYYAISAIAYDNKGNASKRVQTEVVISGAGMSADRTALTLDGQSRIQMLANGNEQKPLVLSLRDAEGQPVTGMKDQIKTELTFKPAGNIVTRSLKVTKSQAKPTLGEFTETEAGVYQSVFTTGTQSGEATITVSVDGMSKTVTAELRATMMDVANSTLSANEPSGDVVADGQQAYTLTLTAVDSEGNPVTGEASRLRLVPQDTNGVTVGAISEIKPGVYSATVSSTRAGNVVVRAFSEQYQLGTLQQTLKFVAGPLDAAHSSITLNPDKPVVGGTVTAIWTAKDANDNPVTGLNPDAPSLSGAAAAGSTASGWTDNGDGTWTAQISLGTTAGELDVMPKLNGQDAAANAAKVTVVADALSSNQSKVSVAEDHVKAGESTTVTLVAKDAHGNAISGLSLSASLTGTASEGATVSSWTEKGDGSYVATLTTGGKTGELRVMPLFNGQPAATEAAQLTVIAGEMSSANSTLVADNKTPTVKTTTELTFTVKDAYGNPVTGLKPDAPVFSGAASTGSERPSAGNWTEKGNGVYVSTLTLGSAAGQLSVMPRVNGQNAVAQPLVLNVAGDASKAEIRDMTVKVNNQLANGQSANQITLTVVDSYGNPLQGQEVTLTLPQGVTSKTGNTVTTNAAGKVDIELMSTVAGEHNISASVNGAQKTVTVKFNADASTGQANLQVDTAVQKVANGKDAFTLTATVKDQYGNLLPGAVVVFNLPRGVKPLADGNIMVNADKEGKAELKVVSVTAGTYEITASAGNDQPSNAQSVTFVADKTTATISSIEVIGNRAVADGKTKQTYKVTVTDANNNLLKDSEVTLTASPENLVLTPNGTATTNEQGQAIFTATTTVAATYTLTAKVEQADGQESTKTAESKFVADDKNAELAATSDVHSLVADGVTTATLTVTLFSANNPVGGTMWVDIEAPEGVTEADYQFLPSKNDHFASGKITRTFSTNKPGTYTFTFNSLTYGGYEMKPVTVTINAVPADTEGAEEK

SEQ ID NO: 7 - protein, 1415 aa, Escherichia coli
MSRYKTDNKQPRFRYSVLARCVAWANISVQVLFPLAVTFTPVMAARAQHAVQPRLSMENTTVTADNNVEKNVASLAANAGTFLSSQPDSDATRNFITGMATAKANQEIQEWLGKYGTARVKLNVDKNFSLKDSSLEMLYPIYDTPTNMLFTQGAIHRTDDRTQSNIGFGWRHFSENDWMAGVNTFIDHDLSRSHTRIGVGAEYWRDYLKLSANGYIRASGWKTSPDVEDYQERPANGWDIRAEGYLPAWPQLGASLMYEQYYGDEVGLFGKDKRQKDPHAITAEVNYTPVPLLTLSAGHKQGKSGENDTRFGLEVNYRIGEPLEKQLDTDSIRERRMLAGSRYDLVERNNNIVLEYRKSEVIRIALPERIEGKGGQTVSLGLVVSKATHGLKNVQWEAPSLLAAGGKITGQGNQWQVTLPAYQAGKDNYYAISAIAYDNKGNASKRVQTEVVISGAGMSADRTALTLDGQSRIQMLANGNEQKPLVLSLRDAEGQPVTGMKDQIKTELTFKPAGNIVTRSLKVTKSQAKPTLGEFTETEAGVYQSVFTTGTQSGEATITVSVDGMSKTVTAELRATMMDVANSTLSANEPSGDVVADGQQAYTLTLTAVDSEGNPVTGEASRLRLVPQDTNGVTVGAISEIKPGVYSATVSSTRAGNVVVRAFSEQYQLGTLQQTLKFVAGPLDAAHSSITLNPDKPVVGGTVTAIWTAKDANDNPVTGLNPDAPSLSGAAAAGSTASGWTDNGDGTWTAQISLGTTAGELDVMPKLNGQDAAANAAKVTVVADALSSNQSKVSVAEDHVKAGESTTVTLVAKDAHGNAIRGLSLSASLTGTASEGATVSSWTEKGDGSYVATLTTGGKTGELRVMPLFNGQPAATEAAQLTVIAGEMSSANSTLVADNKTPTVKTTTELTFTVKDAYGNPVTGLKPDAPVFSGAASTGSERPSAGNWTEKGNGVYVSTLTLGSAAGQLSVMPRVNGQNAVAQPLVLNVAGDASKAEIRDMTVKVNNQLANGQSANQITLTVVDSYGNPLQGQEVTLTLPQGVTSKTGNTVTTNAAGKVDIELMSTVAGEHNISASVNGAQKTVTVKFNADASTGQANLQVDTAVQKVANGKDAFTLTATVKDQYGNLLPGAVVVFNLPRGVKPLADGNIMVNADKEGKAELKVVSVTAGTYEITASAGNDQPSNAQSVTFVADKTTATISSIEVIGNRAVADGKTKQTYKVTVTDANNNLLKDSEVTLTASPENLVLTPNGTATTNEQGQAIFTATTTVAATYTLTAKVEQADGQESTKTAESKFVADDKNAELAATSDVHSLVADGVTTATLTVTLFSANNPVGGTMWVDIEAPEGVTEADYQFLPSKNDHFASGKITRTFSTNKPGTYTFTFNSLTYGGYEMKPVTVTINAVPADTEGAEEK

SEQ ID NO: 8 - protein, 1416 aa, Escherichia coli
MSRYKTDNKQPRFRYSVLARCVAWANISVQVLFPLAVTFTPVMAARAQHAVQPRLSMENTTVTADNNVEKNVASLAANAGTFLSSQPDSDATRNFITGMATAKANQEIQEWLGKYGTARVKLNVDKKFSLKDSSLEMLYPIYDTPTNMLFTQGAIHRTDDRTQSNIGFGWRHFSENDWMAGVNTFIDHDLSRSHTRIGVGAEYWRDYLKLSANGYIRASGWKKSPDVEDYQERPANGWDIRAEGYLPAWPQLGASLMYEQYYGDEVGLFGKDKRQKDPHAITAEVNYTPVPLLTLSAGHKQGKSGENDTRFGLEVNYRIGEPLEKQLDTDSIRERRMLAGSRYDLVERNNNIVLEYRKSEVIRIALPERIEGKGGQTVSLGLVVSKATHGLKNVQWEAPSLLAAGGKITGQGNQWQVTLPAYQAGKDNYYAISAIAYDNKGNASKRVQTEVVISGAGMSADRTALTLDGQSRIQMLANGNEQKPLVLSLRDAEGQPVTGMKDQIKTELTFKPAGNIVTRTLKATKSQAKPTLGEFTETEAGVYQSVFTTGTQSGEATITVSVDDMSKTVTAELRATMMDVANSTLSANEPSGDVVADGQQAYTLTLTAVDSEGNPVTGEASRLRLVPQDTNGVTVGAISEIKPGVYSATVSSTRAGNVVVRAFSEQYQLGTLQQTLKFVAGPLDAAHSSITLNPDKPVVGGTVTAIWTAKDANDNPVTGLNPDAPSLSGAAAAGSTASGWTDNGDGTWTAQISLGTTAGELDVMPKLNGQDAAANAAKVTVVADALSSNQSKVSVAEDHVKAGESTTVTLVAKDAHGNAISGLSLSASLTGTASEGATVSSWTEKGDGSYVATLTTGGKTGELRVMPLFNGQPAATEAAQLTVIAGEMSSANSTLVADNKTPTVKTTTELTFTVKDAYGNPVTGLKPDAPVFSGAASTGSERPSAGNWTEKGNGVYVSTLTLGSAAGQLSVMPRVNGQNAVAQPLVLNVAGDASKAEIRDMTVKVNNQLANGQSANQITLTVVDSYGNPLQGQEVTLTLPQGVTSKTGNTVTTNAAGKVDIELMSTVAGELEIEASVKNSQKTVKVKFKADFSTGQASLEVDAAAQKVANGKDAFTLTATVKDQYGNLLPGAVVVFNLPRGVKPLADGNIMVNADKEGKAELKVVSVTAGTYEITASAGNDQPSNAQSVTFVADKTTATISSIEVIGNRAVADGKTKQTYKVTVTDANNNLLKDSEVTLTASPENLVLTPNGTATTNEQGQAIFTATTTVAATYTLTAKVEQADGQESTKTAESKFVADDKNAVLAASPERVDSLVADGKTTATLTVTLMSGVNPVGGTMWVDIEAPEGVTEADYQFLPSKNDHFASGKITRTFSTNKPGTYTFTFNSLTYGGYEMKPVTVTINAVPADTEGAEEK

SEQ ID NO: 9 - protein, 1416 aa, Escherichia coli
MSRYKTDNKQPRFRYSVLARCVAWANISVQVLFPLAVTFTPVMAARAQHAVQPRLSMENTTVTADNNVEKNVASLAANAGTFLSSQPDSDATRNFITGMATAKANQEIQEWLGKYGTARVKLNVDKNFSLKDSSLEMLYPIYDTPTNMLFTQGAIHRTDDRTQSNIGFGWRHFSENDWMAGVNTFIDHDLSRSHTRIGVGAEYWRDYLKLSANGYIRASGWKKSPDVEDYQERPANGWDIRAEGYLPAWPQLGASLMYEQYYGDEVGLFGKDKRQKDPHAITAEVNYTPVPLLTLSAGHKQGKSGENDTRFGLEVNYRIGEPLEKQLDTDSIRERRMLAGSRYDLVERNNNIVLEYRKSEVIRIALPERIEGKGGQTVSLGLVVSKATHGLKNVQWEAPSLLAAGGKITGQGNQWQVTLPAYQAGKDNYYAISAIAYDNKGNASKRVQTEVVISGAGMSADRTALTLDGQSRIQMLANGNEQKPLVLSLRDAEGQPVTGMKDQIKTELTFKPAGNIVTRTLKATKSQAKPTLGEFTETEAGVYQSVFTTGTQSGEATITVSVDDMSKTVTAELRATMMDVSNSTLSANEPSGDVVADGQQAYTLTLTAVDSEGNPVTGEASRLRLVPQDTNGVTVGAISEIKPGVYSATVSSTRAGNVVVRAFSEQYQLGTLQQTLKFVAGPLDAAHSSITLNPDKPVVGGTVTAIWTAKDANDNPVTGLNPDAPSLSGAAAAGSTASGWTDNGDGTWTAQISLGTTAGELDVMPKLNGQDAAANAAKVTVVADALSSNQSKVSVAEDHVKAGESTTVTLVAKDAHGNAISGLSLSASLTGTASEGATVSSWTEKGDGSYVATLTTGGKTGELRVMPLFNGQPAATEAAQLTVIAGEMSSANSTLVADNKTPTVKTTTELTFTMKDAYGNPVTGLKPDAPVFSGAASTGSERPSAGNWTEKGNGVYVSTLTLGSAAGQLSVMPRVNGQNAVAQPLVLNVAGDASKAEIRDMTVKVNNQLANGQSANQITLTVVDSYGNPLQGQEVTLTLPQGVTSKTGNTVTTNAAGKVDIELMSTVAGELEIEASVKNSQKTVKVKFKADFSTGQASLEVDAAAQKVANGKDAFTLTATVKDQYGNLLPGAVVVFNLPRGVKPLADGNIMVNADKEGKAELKVVSVTAGTYEITASAGNDQPSNAQSVTFVADKTTATISSIEVIGNRAVADGKTKQTYKVTVTDANNNLLKDSEVTLTASPENLVLTPNGTATTNEQGQAIFTATTTVAATYTLTAKVEQADGQESTKTAESKFVADDKNAVLAASPERVDSLVADGKTTATLTVTLMSGVNPVGGTMWVDIEAPEGVTEADYQFLPSKNDHFASGKITRTFSTNKPGTYTFTFNSLTYGGYEMKPVTVTINAVPADTEGAEEK

SEQ ID NO: 10 - protein, 1416 aa, Escherichia coli
MSRYKTGHKQPRFRYSVLARCVAWTNISVQVLFPLAVTFTPVMAARAQHAVQPRLSMGNTTVTADNNVEKNVASFAANAGTFLSSQPDSDATRNFITGMATAKANQEIQEWLGKYGTARVKLNVDKDFSLKDSSLEMLYPIYDTPTNMLFTQGAIHRTDDRTQSNIGFGWRHFSENDWMAGVNTFIDHDLSRSHTRIGVGAEYWRDYLKLSANGYIRASGWKKSPDVEDYQERPANGWDIRAEGYLPAWPQLGASLMYEQYYGDEVGLFGKDKRQKDPHAITAEVNYTPVPLLTLSAGHKQGKSGENDTRFGLEVNYRIGEPLEKQLDTDSIRERRMLAGSRYDLVERNNNIVLEYRKSEVIRIALPERIEGKGGQTVSLGLVVSKATHGLKNVQWEAPSLLAAGGKITGQGNQWQVTLPAYQAGKDNYYAISAIAYDNKGNASKRVQTEVVISGAGMSADRTALTLDGQSRIQMLANGNEQKPLVLSLRDAEGQPVTGMKDQIKTELTFKPAGNIVTRTLKATKSQAKPTLGEFTETEAGVYQSVFTTGTQSGEATITVSVDDMSKTVTAELRATMMNVANSTLSANEPSGDVVADGRQAYTLTLTAVDSEGNPVTGEASRLRLVPQDTNGVTVGAISEIKPGGYSATVSSTRAGNVVVRVFSEQYQLGTLQQTLKFVAGPLDAAHSSITLNPDKPVVGGTVTAIWTAKDANDNPVTGLNPDAPSLSGAAAAGSTASGWTDNGDGTWTAQISLGTTAGELDVMPKLNGQDAAANAAKVTVVADALSSNQSKVSVAEDHVKAGESTTVTLVAKDAHGNAISGLSLSASLTGTASEGATVSSWTEKGDGSYVATLTTGGKTGELRVMPLFNGQPAATEAAQLTVIAGEMSSANSTLVADNKTPTVKTTTELTFTVKDAYGNPVTGLKPDAPVFSGAASTGSERPSAGNWTEKGNGVYVSTLTLGSAAGQLSVMPRVNGQNAVAQPLVLNVAGDASKAEIRDMTVKVNNQLANGQSANQITLTVVDSYGNPLQGQEVTLTLPQGVTSKTGNTVTTNAAGKVDIELMSTVAGELEIEASVKNSQKTVKVKFKADFSTGQASLEVDAAAQKVANGKDAFTLTATVKDQYGNLLPGAVVVFNLPRGVKPLADGNIMVNADKEGKAELKVGSVTAGTYEITASAGNDQPSNAQSVTFVADKTTATISSIEVIGNRAVADGKTKQTYKVTVTDANNNLLKDSEVTLTASPENLVLTPNGTATTNEQGQAIFTATTTVAATYTLTAKVEQADGQESTKTAESKFVADDKNAVLAASPERVDSLVADGKTTATLTVTLMSGVNPVGGTMWVDIEAPEGVTEADYQFLPSKNDHFASGKITRTFSTNKPGTYTFTFNSLTYGGYEMKPVTVTINAVPADTEGAEEK

SEQ ID NO: 11 - protein, 1417 aa, Escherichia coli
MSRYKTGHKQPLFRYSVLARCVAWANISVQVLFPLAVTFTPVMAAHAQHAVQPRLSMENTTVTADNNVEKNVASFAANAGTFLSSQPDSDATRNFITGMATAKANQEIQEWLGKYGTARVKLNVDKDFSLKDSSLEMLYPIYDTPTNMLFTQGAIHRTDDRTQSNIGFGWRHFSGNDWMAGVNTFIDHDLSRSHTRIGVGAEYWRDYLKLSANGYIRASGWKKSPDIEDYQERPANGWDIRAEGYLPAWPQLGASLMYEQYYGDEVGLFGKDKRQKDPHAISAEVTYTPVPLLTLSAGHKQGKSGENDTRFGLEVNYRIGEPLEKQLDTDSIRERRMLAGSRYDLVERNNNIVLEYRKSEVIRIALPERIEGKGGQTLSLGLVVSKATHGLKNVQWEAPSLLAEGGKITGQGSQWQVTLPAYRPGKDNYYAISAVAYDNKGNASKRVQTEVVITGAGMSADRTALTLDGQSRIQMLANGNEQRPLVLSLRDAEGQPVTGMKDQIKTELTFKPAGNIVTRTLKATKSQAKPTLGEFTETEAGVYQSVFTTGTQSGEATITVSVDGMSKTVTAELRATMMDVANSTLSANEPSGDVVADGQQAYTLTLTAVDTDGNPVTGEASRLRFVPQDTNGVTIGTISEIKPGVYSATVSSTRAGNVVVRAFSEQYQLGTLQQTLKFVAGPLDAAHSSITLNPDKPVVGGTVTAIWTVKDAYDNPVTSLTPEAPSLAGAAAVGSTASGWTNNGDGTWTAQITLGSTAGELEVMPKLNGQDAAANAAKVTVVADALSSNQSKVSVAEDHVKAGESTTVTLIAKDAHGNAISGLSLSASLTGTASEGATVSSWTEKGDGSYVATLTTGGKTGELRVMPLFNGQPAATEAAQLTVIAGEMSSANSTLVADNKAPTVKTTTELTFTVKDAYGNPVTGMKPDAPVFSGAASTGTERPSTGDWTETSNGVYVATLTLGSAAGQLSVMPRVNGQNAVAQPLVLNVAGDASKAEIRDMTVKVDNQLANGQSTNQVTLTVVDTYGNPLQGQNVTLTLPKGVTSKTGNTVTTDAAGKADIELMSTVAGEHSITASVNNAQKTVTVKFKADFSTGQASLEVDSAAPKVANGKDAFTLTATVEDKNGNPVPGSLVTFNLPRGVKPLTGDNVWVKANGEGKAELQVVSVTAGTYEITASAGNSQPSDTQTITFVADKATATVSGIEVMGNYALADGKAKQTYKVTVTDANNNLVKDSEVTLTASPASLNLEPNGTATTNEQGQAIFTATTTVAATYTLKAQVSQTNGQVSTKTAESKFVADDKNAVLTASSDMQSLVADGKSTAKLEVTLMSANNPVGGNMWVDIQTPEGVTEKDYQFLPSKNDHFVSGKITRKFSTSKPGVYTFTFNALTYGGYEMKPVTVTITAVDADTAKDEEAMK

SEQ ID NO: 12 - protein, 1417 aa, Escherichia coli
MSRYKTGHKQPRFRYSVLARCVAWANISVQVLFPLAVTFTPVMAARAQHAVQPRLSMGNTTVTADNNVEKNVASFAANAGTFLSSQPDSDATRNFITGMATAKANQEIQEWLGKYGTARVKLNVDKDFSLKDSSLEMLYPIYDTPTNMLFTQGAIHRTDDRTQSNIGFGWRHFSGNDWMAGVNTFIDHDLSRSHTRIGVGAEYWRDYLKLSANGYIRASGWKKSPDIEDYQERPANGWDIRAEGYLPAWPQLGASLMYEQYYGDEVGLFGKDKRQKDPHAISAEVTYTPVPLLTLSAGHKQGKSGENDTRFGLEVNYRIGEPLEKQLDTDSIRERRMLAGSRYDLVERNNNIVLEYRKSEVIRIALPERIEGKGGQTLSLGLVVSKATHGLKNVQWEAPSLLAEGGKITGQGSQWQVTLPAYRPGKDNYYAISAVAYDNKGNASKRVQTEVVITGAGMSADRTALTLDGQSRIQMLANGNEQRPLVLSLRDAEGQPVTGMKDQIKTELTFKPAGNIVTRTLKATKSQAKPTLGEFTETEAGVYQSVFTTGTQSGEATITVSVDGMSKTVTAELRATMMDVANSTLSANEPSGDVVADGQQAYTLTLTAVDTDGNPVTGEASRLRFVPQDTNGVTIGTISEIKPGVYSATVSSTRAGNVVVRAFSEQYQLGTLQQTLKFVAGPLDAAHSSITLNPDKPVVGGTVTAIWTVKDAYDNPVTSLTPEAPSLAGAAAVGSTASGWTNNGDGTWTAQITLGSTAGELEVMPKLNGQDAAANAAKVTVVADALSSNQSKVSVAEDHVKAGESTTVTLIAKDAHGNAISGLSLSASLTGTASEGATVSSWTEKGDGSYVATLTTGGKTGELRVMPLFNGQPAATEAAQLTVIAGEMSSANSTLVADNKAPTVKTTTELTFTVKDAYGNPVTGMKPDAPVFSGAASTGTERPSTGDWTETSNGVYVATLTLGSAAGQLSVMPRVNGQNAVAQPLVLNVAGDASKAEIRDMTVKVDNQLANGQSTNQVTLTVVDTYGNPLQGQNVTLTLPKGVTSKTGNTVTTDAAGKADIELMSTVAGEHSITASVNNAQKTVTVKFKADFSTGQASLEVDSAAPKVANGKDAFTLTATVEDKNGNPVPGSLVTFNLPRGVKPLTGDNVWVKANGEGKAELQVVSVTAGTYEITASAGNSQPSDTQTITFVADKATATVSGIEVMGNYALADGKAKQTYKVTVTDANNNLVKDSEVTLTASPASLNLEPNGTATTNEQGQAIFTATTTVAATYTLKAQVSQTNGQVSTKTAESKFVADDKNAVLTASSDMQSLVADGKSTAKLEVTLMSANNPVGGNMWVDIQTPEGVTEKDYQFLSSKNDHFVSGKITRKFSTSKPGVYTFTFNALTYGGYEMKPVTVTITAVDADTAKDEEAMK

SEQ ID NO: 13 - protein, 1417 aa, Escherichia coli
MSRYKTGHKQPRFRYSVLARCVAWANISVQVLFPLAVTFTPVMAARAQHAVQPRLSMGNTTVTADNNVEKNVASFAANAGTFLSSQPDSDATRNFITGMATAKANQEIQEWLGKYGTARVKLNVDKDFSLKDSSLEMLYPIYDTPTNMLFTQGAIHRTDDRTQSNIGFGWRHFSGNDWMAGVNTFIDHDLSRSHTRIGVGAEYWRDYLKLSANGYIRASGWKKSPDIEDYQERPANGWDIRAEGYLPAWPQLGASLMYEQYYGDEVGLFGKDKRQKDPHAISAEVTYTPVPLLTLSAGHKQGKSGENDTRFGLEVNYRIGEPLAKQLDTDSIRERRVLAGSRYDLVERNNNIVLEYRKSEVIRIALPERIEGKGGQTLSLGLVVSKATHGLKNVQWEAPSLLAEGGKITGQGSQWQVTLPAYRPGKDNYYAISAVANDNKGNASKRVQTEVVITGAGMSADRTALTLDGQSRIQMLANGNEQRPLVLSLRDAEGQPVTGMKDQIKTELTFKPAGNIVTRTLKATKSQAKPTLGEFTETEAGVYQSVFTTGTQSGEATITVSVDGMSKTVTAELRATMMDVANSTLSANEPSGDVVADGQQAYTLTLTAVDSEGNPVTGEASRLRFVPQDTNGVTVGAISEIKPGVYSATVSSTRAGNVVVRAFSEQYQLGTLQQTLKFVAGPLDAAHSSITLNPDKPVVGGTVTAIWTAKDANDNPVTGLNPDAPSLSGAAAAGSTASGWTDNGDGTWTAQISLGTTAGELEVIPKLNGQDAAANAAKVTVVADALSSNQSKVSVAEDHVKAGESTTVTLVAKDAHGNAISGLSLSASLTGTASEGATVSSWTEKGDGSYVATLTTGGKTGELRVMPLFNGQPAATEAAQLTVIAGEMSSANSTLVADNEAPTVKTTTKLTFTVKDAYGNLVTGLKPDAPQFSGAASTGTERPSTGDWTETSNGVYVATLTLGSAAGQLSVMPRVNGQNAVAQPLVLNVAGDASKAEIRDMTVKVDNQLANGQSTNQVTLTVVDTYGNPLQGQNVTLTLPKGVTSKTGNTVTTDAAGKADIELMSTVAGEHSITASVNNAQKTVTVKFKADFSTGQASLEVDSAAPKVANGKDAFTLTATVEDKNGNPVPGSLVTFNLPRGVKPLTGDNVWVKANGEGKAELQVVSVTAGTYEITASAGNSQPSDTQTITFVADKATATVSGIEVMGNYALADGKAKQTYKVTVTDANNNLVKDSEVTLTASPASLNLEPNGTATTNEQGQAIFTATTTVAATYTLKAQVSQTNGQVSTKTAESKFVADDKNAVLTASSDMQSLVADGKSTAKLEVTLMSANNPVGGNMWVDIQTPEGVTEKDYQFLPSKNDHFVSGKITRKFSTSKPGVYTFTFNALTYGGYEMKPVTVTITAVDADTAKDEEAMK

SEQ ID NO: 14 - protein, 1417 aa, Escherichia coli
MSRYKTDHKQPRFRYSVLARCVAWANISVQVLFPLAVTFTPVMAARAQHAVQPRLSMGNTTVTADNNVEKNVASFAANAGTFLSSQPDSDATRNFITGMATAKANQEIQEWLGKYGTARVKLNVDKDFSLKDSSLEMLYPIYDTPTNMLFTQGAIHRTDDRTQSNIGFGWRHFSGNDWMAGVNTFIDHDLSRSHTRIGVGAEYWRDYLKLSANGYIRASGWKKSPDIEDYQERPANGWDIRAEGYLPAWPQLGASLMYEQYYGDEVGLFGKDKRQKDPHAISAEVTYTPVPLLTLSAGHKQGKSGENDTRFGLEVNYRIGEPLEKQLDTDSIRERRMLAGSRYDLVERNNNIVLEYRKSEVIRIALPERIEGKGGQTLSLGLVVSKATHGLKNVQWEAPSLLAEGGKITGQGSQWQVTLPAYRPGKDNYYAISAVAYDNKGNASKRVQTEVVITGAGMSADRTALTLDGQSRIQMLANGNEQRPLVLSLRDAEGQPVTGMKDQIKTELTFKPAGNIVTRTLKATKSQAKPTLGEFTETEAGVYQSVFTTGTQSGEATITVSVDGMSKTVTAELRATMMDVANSTLSANEPSGDVVADGQQAYTLTLTAVDTDGNPVTGEASRLRFVPQDTNGVTIGTISEIKPGVYSATVSSTRAGNVVVRAFSEQYQLGTLQQTLKFVAGPLDAAHSSITLNPDKPVVGGTVTAIWTAKDANDNPVTGLNPDAPSLSGAAAAGSTASGWTDNGDGTWTAQISLGTTAGELEVIPKLNGQDAAANAAKVTVVADALSSNQSKVSVAEDHVKAGESTTVTLIAKDAHGNAISGLSLSASLTGAASEGATVSGWTEKGDGSYVATLTTGGKTGELLVMPLFNGQPAATEAAQLTVIAGEMSSANSTLVADNKAPTVKTTTKLTFTVKDAYGNLVTGLKPDAPQFSGAASTGTERPSTGDWTETSNGVYVATLTLGSAAGQLSVMPRVNGQNAVAQPLVLNVAGDASKAEIRDMTVKVDNQLANGQSTNQVTLTVVDTYGNPLQGQNVTLTLPKGVTSKTGNTVTTDAAGKADIELMSTVAGEHSITASVNNAQKTVTVKFKADFSTGQASLEVDSAAPKVANGKDAFTLTATVEDKNGNPVPGSLVTFNLPRGVKPLTGDNVWVKANDEGKAELQVVSVTAGTYEITASAGNSQPSDTQTITFVADKATATVSGIEVIGNYALADGKAKQTYKVTVTDANNNLVKDSDVTLTASPASLNLEPNGTATTNEQGQAIFTATTTVAATYTLKAQVSQTNGQVSTKTAESKFVADDKNAVLTASSDMQSLVADGKSTAKLEVTLMSANNPVGGNMWVDIQTPEGVTEKDYQFLPSKNDHFVSGKITRKFSTSKPGVYTFTFNALTYGGYEMKPVTVTITAVDADTAKDEEAMK

SEQ ID NO: 15 - protein, 1417 aa, Escherichia coli
MSHYKTGHKQPRFRYSVLARCVAWANISVQVLFPLAVTFTPVMAARAQHAVQPRLSMGNTTVTADNNVEKNVASFAANAGTFLSSQPDSDATRNFITGMATAKANQEIQEWLGKYGTARVKLNVDKDFSLKDSSLEMLYPIYDTPTNMLFTQGAIHRTDDRTQSNIGFGWRHFSGNDWMAGVNTFIDHDLSRSHTRIGVGAEYWRDYLKLSANGYIRASGWKKSPDVEDYQERPANGWDIRAEGYLPAWPQLGASLMYEQYYGDEVGLFGKDKRQKDPHAISAEVTYTPVPLLTLSAGHKQGKSGENDTRFGLEVNYRIGEPLAKQLDTDSIRERRVLAGSRYDLVERNNNIVLEYRKSEVIRIALPERIEGKGGQTLSLGLVVSKATHGLKNVQWEAPSLLAEGGKITGQGSQWQVTLPAYRPGKDNYYAISAVAYDNKGNASKRVQTEVVITGAGMSADRTALTLDGQSRIQMLANGNEQRPLVLSLRDAEGQPVTGMKDQIKTELAFKPAGNIVTRSLKATKSQAKPTLGEFTETEAGVYQSVFTTGTQSGEATITVSVDGMSKTVTAELRATMMDVANSTLSANEPSGDVVADGQQAYTLTLTAVDSEGNPVTGEASRLRFVPQDTNGVTVGAISEIKPGVYSATVSSTRAGNVVVRAFSEQYQLGTLQQTLKFVAGPLDAAHSSITLNPDKPVVGGTVTAIWTVKDAYDNPVTSLTPEAPSLAGAAAVGSTASGWTNNGDGTWTAQITLGSTAGELEVMPKLNGQDAAANAAKVTVVADALSSNQSKVSVAEDHVKAGESTTVTLVAKDAHGNAISGLSLSASLTGTASEGATVSSWTEKGDGSYVATLTTGGKTGELRVMPLFNGQPAATEAAQLTVIAGEMSSANSTLVADNKAPTVKTTTELTFTVKDAYGNPVTGMKPDAPVFSGAASTGTERPSTGDWTETSNGVYVATLTLGSAAGQLSVMPRVNGQNAVAQPLVLNVAGDASKAEIRDMTVKVDNQLANGQSTNLVTLTVVDTYGNPLQGQEVTLNLPQGVTSKTGNTVTTNAAGKADIELISTVAGELEIAAAVKNSQKTVTVKFNADASTGQANLQVDTAVQKVANGKDAFTLTATVEDKNGNPVPGSLVTFNLPRGVKPLTGDNVWVKANDEGKAELQVVSVTAGTYEITASAGNSQPSNTQTITFVADKATATVSGIEVMGNYALADGKAKQTYKVTVTDANNNLVKDSEVTLTASPASLNLEPNGTATTNEQGQAIFTATTTVAATYTLKAQVSQTNGQVSTKTAESKFVADDKNAVLTASSDMQSLVADGKSTAKLEVTLMSANNPVGGNMWVDIQTPEGVTEKDYQFLPSKNDHFVSGKITRKFSTSKPGVYTFTFNALTYGGYEMKPVTVTITAVDADTAKDEEAMK

SEQ ID NO: 16 - protein, 1417 aa, Escherichia coli
MSRYKTGHKQPRFRYSVLARCVAWANISVQVLFPLAVTFTPVMAARAQHAVQPRLSMENTTVAADNNVEKNVASFAANAGTFLSSQPDSDATRNFITGMATAKANQEIQEWLGKYGTARVKLNVDKEFSLKDSSLEMLYPIYDTPTNMLFTQGAIHRTDDRTQSNIGFGWRHFSGNDWMAGVNTFIDHDLSRSHTRIGVGAEYWRDYLKLSANGYIRASGWKKSPDVEDYQERPANGWDIRAEGYLPAWPQLGASLMYEQYYGDEVGLFGKDKRQKDPHAITAEVNYTPVPLLTLSAGHKQGKSGENDTRFGLEVNYRIGEPLEKQLDTDSIRERRMLAGSRYDLVERNNNIVLEYRKSEVIRIALPERIEGKGGQTLSLGLVVSKATHGLKNVQWEAPSLLAEGGKITGQGSQWQVTLPAYRPGKDNYYAVSAIAYDNKGNASKRVQTEVVISGAGMSADRTALTLDGQSRIQMLANGNEQKPLVLSLRDAEGQPVTGMKDQIKTELTFKPAGNIVTRTLKATKSQAKPTLGEFTETEAGVYQSVFTTGTQSGEATITVSVDGMSKTVTAELRATMMDVANSTLSANEPSGDVVADGQQAYTLTLTAVDSEGNPVTGEASRLRLVPQDTNGVTVGAISEIKPGVYSATVSSTRAGNVVVRAFSEQYQLGTLQQTLKFVAGPLDAAHSSITLNPDKPVVGGTVTAIWTAKDANDNPVTGLNPDAPSLSGAAAAGSTASGWTNNGDGTWTAQITLGSTAGELEVMPKLNGQDAAANAAKVTVVADALSSNQSKVSVAEDHVKAGESTTVTLIAKDAHGNAISGLSLSASLTGTASEGATISSWTEKGDGSYVATLTTGGKTGELRVMPLFNGQPAATEAAQLTVIAGEMSSANSTLVADNKTPTVKTTTELTFTVKDAYGNPVTGLKPDAPVFSGAASTGSARPSAGSWTEQSNGVYVATLTLGSAAGQLSVMPRVNGQNAVAQPLVLNVAGDASRAVISDMAVKVNNQLANGQSANQVTLTVVDSYGNPLQGQEVTLTLPQGVTSKTGNTVTTNAAGKADIELISTVAGELEIAAAVKNSQKTVTVKFNADASTGQANLQVDTAVQKVANGKDAFTLTATVEDKNGNPVPGTLVTFNLPRGVKPLTGDNVWVKANDEGKAELQVVSVTAGTYEITASAGNDQPSDAQTITFVADKATATVSGIEVIGNYALADGKAKQTYKVTVTDANNNLLKDSDVTLTASPASLNLEPNGTATTNEQGQAIFTATTTVAATYTLKAQVSQTNGQVSTKTAESKFVADDKNAELTASSDVQSLVADGKSTAKLEVTLFSANNPVGGNVWVDIEAPEGVTEKDYQFLPSKNDHFVSGKITRTFSTSKPGVYTFTFNALTYGGYEMKPVTVTITAVDADTAKGEEAMK

SEQ ID NO: 17 - protein, 1417 aa, Escherichia coli
MSRYKTGHKQPRFRYSVLARCVAWANISVQVLFPLAVTFTPVMAARAQHAVQPRLSMGNTTVTADNNVEKNVASFAANAGTFLSSQPDSDATRNFITGMATAKANQEIQEWLGKYGTARVKLNVDKDFSLKDSSLEMLYPIYDTPTNMLFTQGAIHRTDDRTQSNIGFGWRHFSGNDWMAGVNTFIDHDLSRSHTRIGVGAEYWRDYLKLSANGYIRASGWKKSPDIEDYQERPANGWDIRAEGYLPAWPQLGASLMYEQYYGDEVGLFGKDKRQKDPHAISAEVTYTPVPLLTLSAGHKQGKSGENDTRFGLEVNYRIGEPLAKQLDTDSIRERRVLAGSRYDLVERNNNIVLEYRKSEVIRIALPERIEGKGGQTLSLGLVVSKATHGLKNVQWEAPSLLAEGGKITGQGSQWQVTLPAYRPGKDNYYAISAVAYDNKGNTSKRVQTEVVITGAGMSADRTALTLDGQSRIQMLANGNEQKPLVLSLRDAEGQPVTGMKDQIKTELTFKPAGNIVTRSLKATKSQAKPTLGEFTETEAGVYQSVFTTGTQSGEATITVSVDGMSKTVTAELRATMMDVANSTLSANEPSGDVVADGQQAYTLTLTAVDSEGNPVTGEASRLRFVPQDTNGVTVGAISEIKPGVYSAAVSSTRAGNVVVRAFSEQYQLGTLQQTLKFVAGPLDAAHSSITLNPDKPVVGGTVTAIWTVKDAYDNPVTSLTPEAPSLAGAAAEGSTASGWTNNGDGTWTAQITLGSTAGELEVMPKLNGQNAAANAAKVTVVADALSSNQSKVSVAEDHVKAGESTTVTLVAKDAHGNAISGLALSASLTGTASEGATVSSWTEKGNGSYVATLTTGGKTGELRVMPLFNGQPAATEAAQLTVIAGEMSSANSTLVADNKAPTVKTTTELTFTVKDAYGNPVTGLKPDAPVFSGAASTGSERPSAGNWTEKGNGVYVSTLTLGSAAGQLSVMPRVNGQNAVAQPLVLNVAGDASKAEIRDMTVKVNNQLANGQSANQITLTVVDTYGNPLQGQEVTLTLPQGVTSKTGNTVTTNAAGKADIELMSTVAGEHNISASVNGAQKTVTVKFNADASTGQANLQVDAAAQKVANGKDAFTLTANVEDKNGNPVPGSLVTFNLPRGVKPLTGDNVWVKANDEGKAELQVVSVTAGTYEITASAGNSQPSNTQTITFVADKATATVSGIEVIGNYALADGNAKQTYKVTVTDANNNLLKDSEVTLTASPANLVLTPNGTAKTNEQGQAIFTATTTVAAKYTLTAKVSQADGQESTKTAESKFVADDTNAVLTASSDVTSLVADGISTAKLEVTLMSANNPVGGNMWVDIKTPEGVTEKDYQFLPSKNDHFVSGKITRTFSTSKPGVYTFTFNALTYGGYEMKPVTVTITAVDADTAKGEEAMN

SEQ ID NO: 18 - protein, 1417 aa, Escherichia coli
MSRYKTGHKQPQFRYSVLARCVAWANISVQVLFPLAVTFTPVMAARAQHAVQPRLSMGNTTVTADSNVEKNVASFAANAGTFLSSQPDSDATRNFITGMATAKANQEIQEWLGKYGTARVKLNVDKDFSLKDSSLEMLYPIYDTPTNMLFTQGAIHRTDDRTQSNIGFGWRHFSGNDWMAGVNTFIDHDLSRSHTRIGVGAEYWRDYLKLSANGYIRASGWKKSPDIEDYQERPANGWDIRAEGYLPAWPQLGASLMYEQYYGDEVGLFGKDKRQKDPHAISAEVTYTPVPLLTLSAGHKQGKSGENDTRFGLEVNYRIGEPLAKQLDTDSIRERRMLAGSRYDLVERNNNIVLEYRKSEVIRIALPDRIAGKGGQTVSLGLVVSKATHGLKNVQWEAPSLLAAGGKITGQGNQWQVTLPAYQAGKDNYYAISAVAYDNKGNASKRVQTEVVITGAGMSAERTALTLDGQSRIQMLANGSEQKPLVLSLRDAEGQPVTGMKDQIKTELTFKPAGNIVTRTLKATKSQAQPTLGEFTETEAGVYQSVFTTGTQSGEATITVSVDDMSKTVTAELRATMMDVANSTLSANEPSGDVVADGQQSHTLTLTAVDTDGNPVTGEASRLRLVPQDTNGVTVGAISEIKPGVYSATVSSTRAGNVVVRAFSEQYQLGTLQQTLKFVAGPLDAAHSSITLNPDKPVVGGTVTAIWTAKDAYDNPVTSLTPEAPSLAGAAAVGSTASGWTNNGDGTWTAQITLGSTAGELDVMPKLNGQDAAANAAKVTVVADALSSNQSKVSVAEDHVKAGESTTVTLIAKDAHGNAISGLSLSASLTGAASEGATVSSWTEKGDGSYVATLTTGGKTGELLVMPLFNGQPAATEAAQLTVIAGEMSSANSTLVADNKAPTVKATTELTFTAKDAYGNPVSGLKLDAPVFSGAASTGSERPSAGSWTEQSNGVYVATLTLGSAAGQLSVMPRVNGQNAVAQPLVLNVAGDASKAEIRDMTVKVDNQLANGQSTNQVTLTVVDTYGNPLQGQEVTLTLPQGVTSKTGNTVTTNAAGKADIELISTVAGELEIAAAVKNSQKTVTVKFNADASTGQANLQVDAAAQKVANGKDAFTLTANVEDKNGNPVPGSLVTFNLPRGVKPLTGDNVWVKANDEGKAELQVVSVTAGTYEITASAGNDQPSDAQTITFVADKTTATVSGIEVIGNYALADGKAKQTYKVTVTDANNNLLKDSEVTLTASPANLALDPDGTAKTNEQGQAIFTATTTVAAKYTLTAKVEQANGQESTKTAESKFVADDKNAVLAASSDVTSLVADGVQTATMTVTLFSANNPVGGNVWVDIEAPEGVTEKDYQFLPSKNDHFVSGKITRTFSTNKPGTYTFTFNSLTYGGYEMKPVTVTITAVDANTATGEEAMK

SEQ ID NO: 19 - protein, 949 aa, Escherichia coli
MKRHLNTSYRLVWNHITGTLVVASELARSRGKRAGVAVALSLAAVTSVPALAADKVVQAGETVNDGTLTNHDNQIVFGTANGMTISTGLELGPDSEENTGGQWIQNGGIAGNTTVTTNGRQVVLEGGTASDTVIRDGGGQSLNGLAVNTTLNNRGEQWVHEGGVATGTIINRDGYQSVKSGGLATGTIINTGAEGGPDSDNSYTGQKVQGTAESTTINKNGRQIILFSGLARDTLIYAGGDQSVHGRALNTTLNGGYQYVHRDGLALNTVINEGGWQVVKAGGAAGNTTINQNGELRVHAGGEATAVTQNTGGALVTSTAATVIGTNRLGNFTVENGKADGVVLESGGRLDVLESHSAQNTLVDDGGTLAVSAGGKATSVTITSGGALIADSGATVEGTNASGKFSIDGTSGQASGLLLENGGSFTVNAGGQAGNTTVGHRGTLTLAAGGSLSGRTQLSKGASMVLNGDVVSTGDIVNAGEIRFDNQTTPNAALSRAVAKSNSPVTFHKLTTTNLTGQGGTINMRVRLDGSNASDQLVINGGQATGKTWLAFTNVGNSNLGVATTGQGIRVVDAQNGATTEEGAFALSRPLQAGAFNYTLNRDSDEDWYLRSENAYRAEVPLYTSMLTQAMDYDRILAGSRSHQTGVNGENNSVRLSIQGGHLGHDNNGGIARGATPESSGSYGFVRLEGDLLRTEVAGMSLTTGVYGAAGHSSVDVKDDDGSRAGTVRDDAGSLGGYLNLVHTSSGLWADIVAQGTRHSMKASSDNNDFRARGWGWLGSLETGLPFSITDNLMLEPQLQYTWQGLSLDDGQDNAGYVKFGHGSAQHVRAGFRLGSHNDMTFGEGTSSRDTLRDSAKHSVSELPVNWWVQPSVIRTFSSRGDMSMGTAAAGSNMTFSPSRNGTSLDLQAGLEARIRENITLGVQAGYAHSVSGSSAEGYNGQATLNMTF

SEQ ID NO: 20 - protein, 949 aa, Escherichia coli; identical to SEQ ID NO: 19

SEQ ID NO: 21 - protein, 949 aa, Escherichia coli
MKRHLNTSYRLVWNHITGTLVVASELARSRGKRAGVAVALSLAAVTSVPALAADTVVQAGETVNGGTLTNHDNQIVLGTANGMTISTGLELGPDSEENTGGQWIQNGGIAGNTTVTTNGRQVVLEGGTASDTVIRDGGGQSLNGLAVNTTLNNRGEQWVHEGGVATGTIINRDGYQSVKSGGLATGTIINTGAEGGPDSDNSYTGQKVQGTAESTTINKNGRQIILFSGIARDTLIYAGGDQSVHGRALNTTLNGGYQYVHKDGLALNTVINEGGWQVVKAGGAVGNTTINQNGELRVHAGGEATAVTQNTGGALVTSTAATVTGANRLGHFSVGNGMADNVVLENGGRLDVLEGHSAQNTLVDDGGTLAVSAGGKATDVTMTSGGALIADSGATVEGTNASGKFSIDGISGQASGLLLENGGSFTVNAGGQAGNTTVGHRGTLTLAAGGSLSGRTQLSKGASMVLNGDVVSTGDIVNAGEIRFDNQTTQDAVLSRAVAKGDSPVTFHKLTTNNLTGQGGTINMRVRLDGSNASDQLVINGGQATGKTWLAFTNVGNSNLGVATSGQGIRVVDAQNGATTEEGAFALSRPLQAGAFNYTLNRDSDEDWYLRSENAYRAEVPLYASMLTQAMDYDRILAGSRSHQTGVNGENNSVRLSIQGGHLGHDNNGGIARGATPESSGSYGLVRLEGDLLRTEVAGMSLTTGVYGAAGHSSVDVKDDDGSRAGTVRDDAGSLGGYLNLTHTSSGLWADIVAQGTRHSMKASSDNNDFRARGWGWLGSLETGLPFSITDNLMLEPQLQYTWQGLSLDDGQDNAGYVKFGHGSAQHVRAGFRLGSHNDMTFGEGTSSRDTLRDSAKHSVSELPVNWWVQPSVIRTVSSRGDMSMGTAAAGSNMTFSPSRNGTSLDLQAGLEARVRENITLGVQAGYAHSVSGSSAEGYNGQATLNMTF

SEQ ID NO: 22 - protein, 949 aa, Escherichia coli
MKRHLNTSYRLVWNHITGTLVVASELARSRGKRAGVAVALSLAAVTSVPALAADTVVQAGETVNGGTLTNHDNQIVLGTANGMTISTGLELGPDSEENTGGQWIQNGGIAGNTTVTTNGRQVVLEGGTASDTVIRDGGGQSLNGLAVNTTLNNRGEQWVHEGGVATGTIINRDGYQSVKSGGLATGTIINTGAEGGPDSDNSYTGQKVQGTAESTTINKNGRQIILFSGIARDTLIYAGGDQSVHGRALNTTLNGGYQYVHKDGLALNTVINEGGWQVVKAGGAVGNTTINQNGELRVHAGGEATAVTQNTGGALVTSTAATVTGANRLGHFSVGNGMADNVVLENGGRLDVLEGHSAQNTLVDDGGTLAVSAGGKATDVTMTSGGALIADSGATVEGTNASGKFSIDGISGQASGLLLENGGSFTVNAGGQAGNTTVGHRGTLTLAAGGSLSGRTQLSKGASMVLNGDVVSTGDIVNAGEIRFDNQTTQDAVLSRAVAKGDSPVTFHKLTTNNLTGQGGTINMRVRLDGSNASDQLVINGGQATGKTWLAFTNVGNSNLGVATSGQGIRVVDAQNGATTEESAFALSRPLHAGAFNYTLNRDSDEDWYLRSENAYRAEVPLYASMLTQAMDYDRILAGSRSHQSGVSGENNSVRLSIQGGHLGHDNNGGIARGATPESNGSYGFVRLEGDLLRTEVAGMSLTTGVYGAAGHSSVDVKNDDGSRAGTVRDDAGSLGGYLNLVHTSSGLWADIVAQGTHHSMKASSDNNDFRARGWGWLGSLETGLPFSITDNLMLEPQLQYTWQGLSLDDGQDNAGYVKFGHGSAQHVRAGFRLGSHNDMTFGEGTSSRDTLRDSAKHRVRELPVNWWVQPSVIRTVSSRGDMSMGTAAAGSNMTFSPSRNGTSLDLQAGLEARVRENITLGVQAGYAHSVSGSSAEGYNGQATLNMTF

SEQ ID NO: 23 - protein, 948 aa, Escherichia coli
MKRHLNTSYRLVWNHITGTLVVASELARSRGKRTGVAVALSLAAVTSVPVLAADTVVQAGETVSGGTLTNHDNQIVLGTANGMTISTGLEYGPDNEANTGGQWIQNGGIANNTTVTGGGLQRVNAGGSVSDTVISAGGGQSLQGQAVNTTLNGGEQWVHEGGIATGTVINEKGWQAVKSGAMATDTVVNTGAEGGPDAENGDTGQFVRGNAVRTTINKNGRQIVAAEGTANTTVVYAGGDQTVHGHALDTTLNGGYQYVHNGGTASGTVVNSDGWQIIKEGGLADFTTVNQKGKLQVNAGGTATHVTLKQGGALVTSTAATVLGSNRLGNFTVENGKADGVVLESGGRLDVLEGHSAQKTRVDDGGTLAVSAGGKATDVTMTSGSALIADSGATVEGTNASGKFSIDGTSGQASGLLLENGGSFTVNAGGLASNTTVGHRGTLTLAAGGSLSGRTQLSKGASMVLNGDVVSTGDIVNAGEIRFDNQTTQDAVLSRAVAKGDSPVTFHKLTTSNLTGQGGTINMRVRLDGSNTSDQLVINGGQATGKTWLAFTNVGNSNLGVATSGQGIRVVDAQNGATTEEGAFALSRPLQAGAFNYTLNRDSDEDWYLRSENAYRAEVPLYASMLTQAMDYDRILAGSRSHQTGVNGENNSVRLSIQGGHLGHDNNGGIARGATPESNGSYGFVRLEGDLLRTEVAGMSLTTGVYGAAGHSSVDVKDDDGSRAGTVRDDAGSLGGYLNLTHTSSGLWADIVAQGTRHSMKASSDNNDFRARGWGWLGSLETGLPFSITDNVMLEPQLQYTWQGLSLDDGQDNAGYVKFGHGSAQHVRAGFRLGSHNDMSFGEGTSSRDTLRDSAKHRVRELPVNWWVQPSVIRTFSSRGDMSMGTAAAGSNMTFSPSRNGTSLDLQAGLEARVRENITLGVQAGYAHSVSGSSAEGYNGQATLNVTF

SEQ ID NO: 24 - protein, 948 aa, Escherichia coli
MKRHLNTSYRLVWNHITGTLVVASELARSRGKRTGVAVALSLAAVTSVPVLAADTVVQAGETVSGGTLTNHDNQIVLGTANGMTISTGLEYGPDNEANTGGQWIQNGGIANNTTVTGGGLQRVNAGGSVSDTVISAGGGQSLQGQAVNTTLNGGEQWVHEGGIATGTVINEKGWQAVKSGAMATDTVVNTGAEGGPDAENGDTGQFVRGNAVRTTINKNGRQIVAAEGTANTTVVYAGGDQTVHGHALDTTLNGGYQYVHNGGTASGTVVNSDGWQIIKEGGLADFTTVNQKGKLQVNAGGTATHVTLKQGGALVTSTAATVLGSNRLGNFTVENGKADGVVLESGGRLDVLEGHSAQKTRVDDGGTLAVSAGGKATDVTMTSGSALIADSGATVEGTNASGKFSIDGTSGQASGLLLENGGSFTVNAGGLASNTTVGHRGTLTLAAGGSLSGRTQLSKGASMVLNGDVVSTGDIVNAGEIRFDNQTTQDAVLSRAVAKGDSPVTFHKLTTSNLTGQGGTINMRVRLDGSNTSDQLVINGGQATGKTWLAFTNVGNSNLGVATSGQGIRVVDAQNGATTEEGAFALSRPLQAGAFNYTLNRDSDEDWYLRSENAYRAEVPLYASMLTQAMDYDRILAGSRSHQTGVNGENNSVRLSIQGGHLGHDNNGGIARGATPESNGSYGFVRLEGDLLRTEVAGMSLTTGVYGAAGHSSVDVKDDDGSRAGTVRDDAGSLGGYLNLTHTSSGLWADIVAQGTRHSMKASSDNNDFRARGWGWLGSLETGLPFSITDNLMLEPQLQYTWQGLSLDDGQDNAGYVKFGHGSAQHVRAGFRLGSHNDMSFGEGTSSRDTLRDSAKHRVRELPVNWWVQPSVIRTFSSRGDMSMGTAAAGSNMTFSPSRNGTSLDLQAGLEARVRENITLGVQAGYAHSVSGSSAEGYNGQATLNVTF

SEQ ID NO: 25 - protein, 948 aa, Escherichia coli
MKRHLNTSYRLVWNHITGTLVVASELARSRGKRTGVAVALSLAAVTSVPVLAADTVVQAGETVSGGTLTNHDNQIVFGTANGMTISTGLEYGPDNEANTGGQWIQNGGIANNTTVTGGGLQRVNAGGSVSDTVISAGGGQSLQGQAVNTTLNGGEQWVHEGGIATGTVINEKGWQAVKSGAMATDTVVNTGAEGGPDAENGDTGQFVRGNAVRTTINENGRQIVAAEGTANTTVVYAGGDQTVHGHALDTTLNGGYQYVHNGGTASDTVVNSDGWQIVKEGGLADFTTVNQKGKLQVNAGGTATNVTLKQGGALVTSTAATVTGSNRLGNFTVENGNADGVVLESGGRLDVLEGHSAWKTLVDDGGTLAVSAGGKATDVTMTSGSALIADSGATVEGTNASGKFSIDGTSGQASGLLLENGGSFTVNAGGLASNTTVGHRGTLTLAAGGSLSGRTQLSKGASMVLNGDVVSTGDIVNAGEIRFDNQTTPDAALSRAVAKGDSPVTFHKLTTSNLTGQGGTINMRVRLDGSNTSDQLVINGGQATGKTWLAFTNVGNSNLGVATSGQGIRVVDAQNGATTEEGAFALSRPLQAGAFNYTLNRDSDEDWYLRSENAYRAEVPLYTSMLTQAMDYDRILAGSRSHQTGVNGENNSVRLSIQGGHLGHDNNGGIARGATPESSGSYGFVRLEGDLLRTEVAGMSLTTGVHGAAGHSSVDVKDDDGSRAGTVRDDAGSLGGYLNLTHTSSGLWADIVAQGTRHSMKASSDNNDFRARGWGWLGSLETGLPFSITDNLMLEPQLQYTWQGLSLDDGQDNAGYVKFGHGSAQHVRAGFRLGSHNDMSFGEGTSSRDTLRDSAKHRVRELPVNWWVQPSVIRTFSSRGDMSMGTAAAGSNMTFSPSRNGTSLDLQAGLEARVRENITLGVQAGYAHSVSGSSAEGYNGQATLNVTF

SEQ ID NO: 26 - protein, 948 aa, Escherichia coli
MKRHLNTSYRLVWNHITGTLVVASELARSRGKRAGVAIALSLAAVTSVPALAADTVVQAGETVNDGTLTNHDNQIVLGTANGMTISTGLEYGPDNEANTGGQWIQNGGIANNTTVTGGGLQRVNAGGSVSDTVISAGGGQSLQGQAVNTTLNGGEQWVHEGGIATGTVINEKGWQAVKSGAMATDTVVNTGAEGGPDAENGDTGQFVRGNAVRTTINKNGRQIVAAEGTANTTVVYAGGDQTVHGHALDTTLNGGYQYVHNGGTASGTVVNSDGWQIIKEGGLADFTTVNQKGKLQVNAGGTATNVTLKQGGALVTSTAATVTGSNRLGNFTVENGKADGVVLESGGRLDVLEGHSAWKTLVDDGGTLAVSAGGKATDVTMTSGGALIADSGATVEGTNASGKFSIDGTSGQASGLLLENGGSFTVNAGGLASNTTVGHRGTLTLAAGGSLSGRTQLSKGASMVLNGDVVSTGDIVNAGEIRFDNQTTPDAVLSRAVAKGDSPVTFHKLTTSNLTGQGGTINMRVRLDGSNTSDQLVINGGQATGKTWLAFTNVGNSNLGVATSGQGIRVVDAQNGATTEEGAFALSRPLQAGAFNYTLNRDSDEDWYLRSENAYRAEVPLYASMLTQAMDYDRILAGSRSHQTGVSGENNSVRLSIQGGHLGHDNNGGIARGATPESSGSYGFVRLEGDLLRTEVAGMSLTTGVYGAAGHSSVDVKDDDGSRAGTARDDAGSLGGYLNLVHTSSGLWADIVAQGTRHSMKASSDNNDFRARGWGWLGSLETGLPFSITDNLMLEPQLQYTWQGLSLDDGQDNAGYVKFGHGSAQHVRAGFRLGSHNDMNFGKGTSSRDTLRDSAKHSVRELPVNWWVQPSVIRTFSSRGDMSMGTAAAGSNMTFSPSRNGTSLDLQAGLEARVRENITLGVQAGYAHSVSGSSAEGYNGQATLNVTF

SEQ ID NO: 27 - protein, 948 aa, Escherichia coli
MKRHLNTSYRLVWNHITGTLVVASELARSRGKGAGVAVALSLAAVTSVPALAADTVVQAGETVNGGTLTNHDNQIVLGTANGMTISTGLEYGPDNEANTGGQWIQNGGIANNTTVTGGGLQRVNAGGSVSDTVISAGGGQSLQGQAVNTTLNGGEQWVHEGGIATGTVINEKGWQAVKSGAMATDTVVNTGAEGGPDAENGDTGQTVYGDAVRTTINKNGRQIVAAEGTANTTVVYAGGDQTVHGHALDTTLNGGYQYVHNGGTASDTVVNSDGWQIIKEGGLADFTTVNQKGKLQVNAGGTATNVTLTQGGALVTSTAATVTGSNRLGNFTVENGNADGVVLESGGRLDVLEGHSAWKTLVDDGGTLAVSAGGKATDVTMTSGGALIADSGATVEGTNASGKFSIDGISGQASGLLLENGGSFTVNAGGLASNTTVGHRGTLTLAAGGSLSGRTQLSKGASMVLNGDVVSTGDIVNAGEIRFDNQTTPDAALSRAVAKGDSPVTFHKLTTSNLTGQGGTINMRVRLDGSNASDQLVINGGQATGKTWLAFTNVGNSNLGVATSGQGIRVVDAQNGATTEEGAFALSRPLQAGAFNYTLNRDSDEDWYLRSENAYRAEVPLYASMLTQAMDYDRILAGSRSHQSGVSGENNSVRLSIQGGHLGHDNNGGIARGATPESNGSYGFVRLEGDLLRTEVAGMSLTTGVYGAAGHSSVDVKDDDGSRAGTVRDDAGSLGGYLHLVHTSSGLWADIVAQGTRHSMKASSDNNDFRARGWGWLGSLETGLPFSITDNLMLEPQLQYTWQGLSLDDGQDNAGYVKFGHGSAQHVRAGFRLGSHNDMNFGKGTSSRDTLHDSAKHSVRELPVNWWVQPSVIRTFSSRGDMSMGTAAAGSNMTFSPSRNGTSLDLQAGLEARVRENITLGVQAGYAHSVSGSSAEGYNGQATLNVTF

SEQ ID NO: 28 - protein, 948 aa, Escherichia coli
MKRHLNTSYRLVWNHITGTLVVASELARSRGKRTGVAVALSLAAVTSVPVLAADTVVQAGETVSGGTLTNHDNQIVFGTANGMTISTGLEYGPDNEANTGGQWIQNGGIANNTTVTGGGLQRVNAGGSVSDTVISAGGGQSLQGQAVNTTLNGGEQWVHEGGIATVTVINEKGWQAVKSGAMATDTVVNTGAEGGPDADNGDTGQFVRGNAVRTTINKNGRQIVAVEGTANTTVVYAGGDQTVHGHALDTTLNGGYQYVHNGGTASDTVVNSDGWQIVKEGGLADFTTVNQKGKLQVNAGGTATNVTLKQGGALVTSTAATVTGSNRLGNFTVENGNADGVVLESGGRLDVLEGHSAWKTRVDDGGTLAVSAGGKATGVTMTSGGALIADSGATVEGTNASGKFSIDGISGQASGLLLENGGSFTVNAGGQASNTTVGHRGTLMLAAGGSLSGRTQLSKGASMVLNGDVVSTGDIVNAGEIYFDNQTTPDAVLSRAVAKGNAPVTFHKLTTSNLTGQGGTINMRVRLDGSNASDQLVINGGQATGKTWLAFTNVGNSNLGVATTGQGIRVVDAQNGATTEEGVFALSRPLQAGAFNYTLNRDSDEDWYLRSENAYRAEVPLYTSMLTQAMDYDRILAGSRSHQTGVNGENNSVRLSIQGGHLGHDNNGGIARGATPESSGSYGFVRLEGDLLRTEVAGMSLTTGVYGAAGHSSVDVKDDDGSRAGTVRDDAGSLGGYLNLVHTSSGLWADIVAQGTRHSMKASSDNNDFRARGWGWLGSLETGLPFSITDNLMLEPQLQYTWQGLSLDDGQDNAGYVKFGHGSTQHVRAGFRLGSHNDMTFGEGTSSRDTLRDSAKHRVRELPVNWWVQPSVIRTFSSRGDMSMGTAAAGSNMTFSPSRNGTSLDLQAGLEARVRENITLGVQAGYAHSVSGSSAEGYNGQATLNVTF

SEQ ID NO: 29 - protein, 948 aa, Escherichia coli
MKRHLNTSYRLVWNHITGTLVVASELARSRGKRAGVAVALSLAAVTSVPALAADTVVQAGETVSGGTLVNHDNQIVFGTANGMTISTGLEYGPDNEANTGGQWIQNGGTANNTTVTGGGLQRVNTGGSVSDTVISAGGGQSLQGQAVNTTLNGGEQWVHEGGIATGTVINEKGWQAIKSGAVATDTVVNTGAEGGPDAENGDTGQTVYGDAVRTTINKNGRQIVAAEGTANTTVVYAGGDQTVHGHALDTTLNGGYQYVHNGGTASGTVVNSDGWQIIKEGGLADFTTVNQKGKLQVNAGGTATNVTLKQGGALVTSTAATVLGSNRLGNFTVENGKADGVVLESGGRLDVLEGHSAWKTLVDDGGTLAVSAGGKATGVTMTSGGALIADSGATVEGTNASGKFSIDGISGQASGLLLENGGSFTVNAGGQASNTTVGHRGTLMLAAGGSLSGRTQLSKGASMVLNGDVVSTGDIVNAGEIYFDNQTTPDAVLSRAVAKGNAPVTFHKLTTSNLTGQGGTINMRVRLDGSNTSDQLVINGGQATGKTWLAFTNVGNSNLGVATSGQGIRVVDAQNGATTEEGAFALSRPLQAGAFNYTLNRDSDEDWYLRSENAYRAEVPLYASMLTQAMDYDRILAGSRSHQSGVSGENNSVRLSIQGGHLGHDNNGGIARGATPESNGSYGFVRLEGDLLRTEVAGMSLTTGVYGAAGHSSVDVKDDDGSRAGTVRDDAGSLGGYLNLTHTSSGLWADIVAQGTRHSMKASSDNNDFRARGWGWLGSLETGLPFSITDNLMLEPQLQYTWQGLSLDDGQDNAGYVKFGHGSAQHVRAGFRLGSHNDMSFGEGTSSRDTLRDSAKHRVRELPVNWWVQPSVIRTFSSRGDMSMGTAAAGSNMTFSPSRNGTSLDLQAGLEARVRENITLGVQAGYAHSVSGSSAEGYNGQATLNVTF

SEQ ID NO: 30 - protein, 948 aa, Escherichia coli
MKRHLNTSYRLVWNHITGTLVVASELARSRGKRAGVAIALSLAAVTSVPALAADTVVQAGETVSGGTLTNHDNQIVFGTANGMTISSGLEYGPDNEANTGGQWIQNGGIANNTTVTGGGLQRVNAGGSVSDTVISAGGGQSLQGQAVNTTLNGGEQWVHEGGIATGTVINEKGWQAVKSGAMATDTVVNTGAEGGPDAENGDTGQFVRGNAVRTTINKNGRQIVAAEGTANTTVVYAGGDQTVHGHALDTTLNGGYQYVHNGGTASGTVVNSDGWQIIKEGGLADFTTVNQKGKLQVNAGGTATHVTLKQGGALVTSTAATVLGSNRLGNFTVENGKADGVVLESGGRLDVLEGHSAQKTRVDDGGTLAVSAGGKATGVTMTSGGALIADSGATVEGTNASGKFSIDGTSGQASGLLLENGGSFTVNAGGQASNTTVGHRGTLMLAAGGSLSGRTQLSKGASMVLNGDVVSTGDIVNAGEIHFDNQTTQDAVLSRAVAKSNSPVTFHKLTTTNLTGQGGTINMRVSLDGSNASDQLVINGGQATGKTWLAFTNVGNSNLGVATSGQGIRVVDAQNGATTEEGAFALSRPLQAGAFNYTLNRDSDEDWYLRSENAYRAEVPLYTSMLTQAMDYDRILAGSRSHQTGVNGENNSVRLSIQGGHLGHDNNGGIARGATPESSGSYGFVRLEGDLLRTEVAGMSLTTGVYGAAGHSSVDVKDDDGSRAGTVRDDAGSLGGYLNLTHTSSGLWADIVAQGTRHSMKASSDNNDFRARGWGWLGSLETGLPFSITDNLMLEPQLHYTWQGLSLDDGQDNAGYVKFGHGSAQHVRAGFRLGSHNDMTFGEGTSSRDTLRDSTKHGVSELPVNWWVQPSVIRTFSSRGDMSMGTAAAGSNMTFSPSRNGTSLDLQAGLEARVRENITLGVQAGYAHSVSGNSAEGYNGQATLNVTF

SEQ ID NO: 31 - protein, 948 aa, Escherichia coli
MKRHLNTSYRLVWNHITGTLVVASELARSRGKRAGVAVALSLAAVTSVPALAADTVVQAGETVNDGTLTNHDNQIVLGTANGMTISTGLEYGPDNEANTGGQWIQNGGIANNTTVTGGGLQRVNAGGSVSDTVISAGGGQSLQGQAVNTTLNGGEQWVHEGGIATGTVINEKGWQAVKSGAMATDTVVNTGAEGGPDAENGDTGQFVRGNAVRTTINENGRQIVAAEGTANTTVVYAGGDQTVHGYALDTTLNGGNQYVHNGGTASGTVVNSDGWQIVKEGGLADFTIVNQKGKLQVNAGGTATNVTLKQGGALVTSTAATVTGSNRLGNFTVENGNADGVVLESGGRLDVLEGHSAWKTLVDDGGTLAVSAGGKATDVTMTSGGALIADSGATVEGTNASGKFSIDGISGQASGLLLENGGSFTVNAGGQAGNTTVGHRGTLTLAAGGSLSGRTQLSKGASMVLNGDVVSTGDIVNAGEIHFDNQTTPDAALSRAVAKGDSPVTFHKLTTSNLTGQGGTINMRVRLDGSNTSDQLVINGGQATGKTWLAFTNVGNSNLGVATTGQGIRVVDAQNGATTEEGAFALSRPLQAGAFNYTLNRDSDEDWYLRSENAYRAEVPLYASMLTQAMDYDRILAGSRSHQTGVNGENNSFRLSIQGGHLGHVNNGGIARGATPESSGSYGLVRLEGDLLRTEVAGMSLTTGVYGAAGHSSVDVKDDDGSRAGTVRDDAGSLGGYLNLVHTSSGLWADIVAQGTRHSMKASSDNNDFRARGWGWLGSLETGLPFSITDNLMLEPQLQYTWQGLSLDDGQDNAGYVKFGHGSAQHVRAGFRLGSHNDMNFGKGTSSRDTLRDSAKHSVRELPVNWWVQPSVIRTFSSRGDMSMGTAAAGSNMTFSPSQNGTTLDLQAGLEARVRENITLGVQAGYAHSVSGSSAEGYNGQATLNVTF

SEQ ID NO: 32 - protein, 948 aa, Escherichia coli
MKRHLNTSYRLVWNHITGTLVVASELARSRGKRAGVAVALSLAAVTPVPALAADTVVEAGETVNGGTLTNHDNQIVFGTTNGMTISTGLEYGTDNEANTGGQWVQDGGTASNTTISSGGLQFVGAGGKATDTIINEGGGQSLKGLALNTTLNGGEQWMHEGAIATGTVINDKGWQVVKPGAVATDTVVNTGAEGGPDAENGDTGQFVRGNAVRTTINKNGRQIVTVEGTANTTVVYAGGDQTVHGHALDTTLNGGNQYVHNGGTTSDTVVNSDGWQIIKEGGLADFTTVNQKGKLQVNAGGTATNVTLKQGGALVTSTAATVTGSNRLGNFAVENGKADGVVLESGGRLDVLEGHSAQKTRVDDGGTLAVSAGGKATGVTMTSGGALIADSGATVEGTNASGKFSIDGISGQASGLLLENGGSFTVNAGGQAGNTTVGHRGTLTLAAGGSLSGRTQLSKGASMVLNGDVVSTGDIVNAGEIRFDNQTTQDAVLSRAVAKGDAPVTFHKLTTSNLTGQGGTINMRVRLDGSNASDQLVINGGQATGKTWLAFTNVGNSNLGVATSGQGIRVVDAQNGATTEEGAFALSRPLQAGAFNYTLNRDSDEDWYLRSENAYRAEVPLYASMLTQAMDYDRILAGSRSHQTGVNGENNSVRLSIQGGHLGHDNNGGIARGATPESSGSYGFVRLESDLLRTEVAGMSVTAGVYSAAGHSSVDVKDDDGSRAGTVRDDAGSLGGYLNLVHTSSGLWADIMAQGTRHSMKASSDNNDFRARGWGWLGSLETGLPFSITDNLMLEPQLQYTWQGLSLDDGQDNAGYVKFGHGSAQHMRAGFRLGSHNDMSFGEGTSSRDTLRDSAKHRVRELPVNWWVQPSVIRTFSSRGDMSMGTAAAGSNMTFSPSQNGTSLDLQAGLEARVRENITLGVQAGYAHSVSGSSAEGYNGQATLNVTF

SEQ ID NO: 33 - protein, 948 aa, Escherichia coli
MKRHLNTSYRLVWNHITGTLVVASELARSRGKRTGVAVALSLATATSVPALAADSVVQAGETVSGGTLENHDNQIVFGTTNGITISTGLEYGPDNEANTGGQWVQDGGTASNTTISSGGLQFVGAGGKATDTIINEGGGQSLKGLALNTTLNGGEQWMHEGAIATGTVINDKGWQVVKPGAVATDTVVNTGAEGGPDAENADTGQFVRGDAVRTTINKNGRQIVVATGVANTTVVYAGGDQTVHGYALDTTLNGGNQYVHNGGTASDTVVNSDGWQIIKEGGLADFTTVNQKGKLQVNAGGTATNVTLKQGGALVTSTAATVLGSNRLGNFTVENGKADGVVLESGGRLDVLEGHSAWKTLVDDGGILAVSAGGKATDVTMTSGGALIADSGATVEGTNASGKFSIDGISGQASGLLLENGGSFTVNAGGQAGNTTVGHRGTLTLAAGGSLSGRTQLSKGASMVLNGDVVSTGDIVNAGEIHFDNQTTQDAVLSRAVAKSNSPVTFHKLTTTNLTGQGGTINMRVSLDGSNASDQLVINGGQATGKTWLAFTNVGNSNLGVATSGQGIRVVDAQNGATTEEGAFALSRPLQAGAFNYTLNRDSDEDWYLRSENAYRAEVPLYTSMLTQAMDYDRILAGSRSHQTGVNGENNSVRLSIQGGHLGHDNNGGIARGATPESSGSYGFVRLEGDLLRTEVAGMSVTAGVYGAAGHSSVDVKDDDGSRAGTVRDDAGSLGGYLNLVHTSSGLWADIVAQGTRHSMKASTDNNDFRARGWGWLGSLETGLPFSITDNLMLEPQLQYTWQGLSLDDGKDNAGYVKFGHGSAQHVRAGFRLGSHNDMTFGEGTSSRAPLRDSAKHSMRELPVNWWVQPSVIRTFSSRGDMSMGTAAAGSNMTFSPSRNGTSLDLQAGLEARVRENITLGVQAGYAHSVIGSSAEGYNGQATLNVTF

SEQ ID NO: 34 - protein, 1039 aa, Escherichia coli
MKRHLNTCYRLVWNHMTGAFVVASELARARGKRGGVAVALSLAAVTSLPVLAADIVVHPGETVNGGTLANHDNQIVFGTTNGMTISTGLEYGPDNEANTGGQWVQDGGTANKTTVTSGGLQRVNPGGSVSDTVISAGGGQSLQGRAVNTTLNGGEQWMHEGAIATGTVINDKGWQVVKPGTVATDTVVNTGAEGGPDAENGDTGQFVRGDAVRTTINKNGRQIVRAEGTANTTVVYAGGDQTVHGHALDTTLNGGYQYVHNGGTASDTVVNSDGWQIVKNGGVAGNTTVNQKGRLQVDAGGTATNVTLKQGGALVTSTAATVTGINRLGAFSVVEGKADNVVLENGGRLDVLTGHTATNTRVDDGGTLDVRNGGTATTVSMGNGGVLLADSGAAVSGTRSDGKAFSIGGGQADALMLEKGSSFTLNAGDTATDTTVNGGLFTARGGTLAGTTTLNNGAILTLSGKTVNNDTLTIREGDALLQGGSLTGNGSVEKSGSGTLTVSNTTLTQKAVNLNEGTLTLNDSTVTTDVIAQRGTALKLTGSTVLNGAIDPTNVTLASGATWNIPDNATVQSVVDDLSHAGQIHFTSTRTGKFVPATLKVKNLNGQNGTISLRVRPDMAQNNADRLVIDGGRATGKTILNLVNAGNSASGLATSGKGIQVVEAINGATTEEGAFVQGNRLQAGAFNYSLNRDSDESWYLRSENAYRAEVPLYASMLTQAMDYDRIVAGSRSHQTGVNGENNSVRLSIQGGHLGHDNNGGIARGATPESSGSYGFVRLEGDLMRTEVAGMSVTAGVYGAAGHSSVDVKDDDGSRAGTVRDDAGSLGGYLNLVHTSSGLWADIVAQGTRHSMKASSDNNDFRARGWGWLGSLETGLPFSITDNLMLEPQLQYTWQGLSLDDGKDNAGYVKFGHGSAQHVRAGFRLGSHNDMTFGEGTSSRAPLRDSAKHSVSELPVNWWVQPSVIRTFSSRGDMRVGTSTAGSGMTFSPSQNGTSLDLQAGLEARVRENITLGVQAGYAHSVSGSSAEGYNGQATLNVTF

SEQ ID NO: 35 - protein, 1039 aa, Escherichia coli
MKRHLNTCYRLVWNHMTGAFVVASELARARGKRGGVAVALSLAAVTSLPVLAADIVVHPGETVNGGTLANHDNQIVFGTTNGMTISTGLEYGPDNEANTGGQWVQDGGTANKTTVTSGGLQRVNPGGSVSDTVISAGGGQSLQGRAVNTTLNGGEQWMHEGAIATGTVINDKGWQVVKPGTVATDTVVNTGAEGGPDAENGDTGQFVRGDAVRTTINKNGRQIVRAEGTANTTVVYAGGDQTVHGHALDTTLNGGYQYVHNGGTASDTVVNSDGWQIVKNGGVAGNTTVNQKGRLQVDAGGTATNVTLKQGGALVTSTAATVTGINRLGAFSVVEGKADNVVLENGGRLDVLTGHTATNTRVDDGGTLDVRNGGTATTVSMGNGGVLLADSGAAVSGTRSDGKAFSIGGGQADALMLEKGSSFTLNAGDTATDTTVNGGLFTARGGTLAGTTTLNNGAILTLSGKTVNNDTLTIREGDALLQGGSLTGNGSVEKSGSGTLTVSNTTLTQKAVNLNEGTLTLNDSTVTTDVIAQRGTALKLTGSTVLNGAIDPTNVTLASGATWNIPDNATVQSVVDDLSHAGQIHFTSTRTGKFVPATLKVKNLNGQNGTISLRVRPDMAQNNADRLVIDGGRATGKTILNLVNAGNSASGLATSGKGIQVVEAINGATTEEGAFVQGNRLQAGAFNYSLNRDSDESWYLRSENAYRAEVPLYASMLTQAMDYDRIVAGSRSHQTGVNGENNSVRLSIQGGHLGHDNNGGIARGATPESSGSYGFVRLEGDLMRTEVAGMSVTAGVYGAAGHSSVDVKDDDGSRAGTVRDDAGCLGGYLNLVHTSSGLWADIVAQGTRHSMKASSDNNDFRARGWGWLGSLETGLPFSITDNLMLEPQLQYTWQGLSLDDGKDNAGYVKFGHGSAQHVRAGFRLGSHNDMTFGEGTSSRAPLRDSAKHSVSELPVNWWVQPSVIRTFSSRGDMRVGTSTAGSGMTFSPSQNGTSLDLQAGLEARVRENITLGVQAGYAHSVSGSSAEGYNGQATLNVTF

SEQ ID NO: 36 - protein, 1039 aa, Escherichia coli
MKRHLNTCYRLVWNHITGAFVVASELARARGKRGGVAVALSLAAVTSLPVLAADIVVHPGETVNGGTLANHDNQIVFGTTNGMTISTGLEYGPDNEANTGGQWVQDGGTANKTTVTSGGLQRVNPGGSVSDTVISAGGGQSLQGRAVNTTLNGGEQWMHEGAIATGTVINDKGWQVVKPGTVATDTVVNTGAEGGPDAENGDTGQFVRGDAVRTTINKNGRQIVRAEGTANTTVVYAGGDQTVHGHALDTTLNGGYQYVHNGGTASDTVVNSDGWQIVKNGGVAGNTTVNQKGRLQVDAGGTATNVTLKQGGALVTSTAATVTGINRLGAFSVVEGKADNVVLENGGRLDVLTGHTATNTRVDDGGTLDVRNGGTATTVSMGNGGVLLADSGAAVSGTRSDGKAFSIGGGQADALMLEKGSSFTLNAGDTATDTTVNGGLFTARGGTLAGTTTLNNGAILTLSGKTVNNDTLTIREGDALLQGGSLTGNGSVEKSGSGTLTVSNTTLTQKAVNLNEGTLTLNDSTVTTDVIAQRGTALKLTGSTVLNGAIDPTNVTLASGATWNIPDNATVQSVVDDLSHAGQIHFTSTRTGKFVPATLKVKNLNGQNGTISLRVRPDMAQNNADRLVIDGGRATGKTILNLVNAGNSASGLATSGKGIQVVEAINGATTEEGAFVQGNRLQAGAFNYSLNRDSDESWYLRSENAYRAEVPLYASMLTQAMDYDRILAGSRSHQTGVSGENNSVRLSIQGGHLGHDNNGGIARGATPESSGSYGFVRLEGDLLRTEVAGMSLTTGVYGAAGHSSVDVKDDDGSRAGTVRDDAGSLGGYLNLTHTSSGLWADIVAQGTRHSMKASSDNNDFRARGWGWLGSLETGLPFSITDNLMLEPQLHYTWQGLSLDDGQDNAGYVKFGHGSAQHVRAGFRLGSHNDMTFGEGTSSRDTLRDSTKHGVSELPVNWWVQPSVIRTFSSRGDMSMGTAAAGSNMTFSPSQNGTSLDLQAGLEARVRENITLGVQAGYAHSVSGSSAEGYNGQATLNVTF

SEQ ID NO: 37 - protein, 1039 aa, Escherichia coli
MKRHLNTSYRLVWNHITGTLVVASELARSRGKRAGVAVALSLAAVTSVPALAADKVVQAGETVNDGTLTNHDNQIVLGTANGMTISTGLEYGPDNEANTGGQWIQNGGIANNTTVTGGGLQRVNAGGSVSDTVISAGGGQSLQGQAVNTTLNGGEQWVHEGGIATGTVINEKGWQAIKSGAVATDTVVNTGAEGGPDAENGDTGQTVYGDAVRTTINKNGRQIVAAEGTANTTVVYAGGDQTVHGHALDTTLNGGYQYVHNGGTASGTVVNSDGWQIVKNGGVAGNTTVNQKGRLQVDAGGTATNVTLKQGGALVTSTAATVTGINRLGAFSVVEGKADNVVLENGGRLDVLTGHTATNTRVDDGGTLDVRNGGTATTVSMGNGGVLLADSGAAVSGTRSDGKAFSIGGGQADALMLEKGSSFTLNAGDTATDTTVNGGLFTARGGTLAGTTTLNNGAILTLSGKTVNNDTLTIREGDALLQGGSLTGNGSVEKSGSGTLTVSNTTLTQKAVNLNEGTLTLNDSTVTTDVIAQRGTALKLTGSTVLNGAIDPTNVTLASGATWNIPDNATVQSVVDDLSHAGQIHFTSTRTGKFVPATLKVKNLNGQNGTISLRVRPDMAQNNADRLVIDGGRATGKTILNLVNAGNSASGLATSGKGIQVVEAINGATTEEGAFIQGNKLQAGAFNYSLNRDSDESWYLRSENAYRAEVPLYASMLTQAMDYDRILAGSRSHQTGVSGENNSVRLSIQGGHLGHDNNGGIARGATPESSGSYGFVRLEGDLLRTEVAGMSVTAGVYGAAGHSSVDVKDDDGSRAGTVRDDAGSLGGYLNLIHNASGLWADIVAQGTRHSMKASSDNNDFRVRGWGWLGSLETGLPFSITDNLMLEPQLQYTWQGLSLDDGQDNASYVKFGHGSAQHVRAGFRLGSHHDMNFGKGTSSRDTLRGSAKHSVRELPVNWWVQPSVIRTFSSRGDMSMGTAAAGSNMTFSPSQNGTSLDLQAGLEARVRENITLGVQAGYVHSVSGSSAEGYNGQATLNVTF

SEQ ID NO: 38 - protein, 1039 aa, Escherichia coli
MKRHLNTSYRLVWNHITGAFVVASELARARGKRAGVAVALSLAAATSLPALAADSVVPAGETVNGGTLINHDRQFVSGTADGMTVSTGLELGADSDNNTGGQQIARGGTARNTRVTANGLQDVMAGGSTSDTVISTGGGQNLRGKASGTVLNGGDQWIHAGGRASGTVINQDGYQTIKHGGLVTGTIVNTGAEGGPDSENVSTGQMVGGIAESTTINKNGRQVIWSSGIARDTLIYTGGDQTVHGEAHNTRLEGGNQYVHKYGLALNTVINEGGWQVVKAGGTAGNTTINQNGELRVHAGGEASDVTQNTGGALVTSTAATVTGTNRLGAFSVVEGKADNVVLENGGRLDVLSGHTATRTLVDDGGTLDVRNGGTATAVSMGNGGVLLADSGAAVSGTRSDGTAFRIGGGQADALMLEKGSSFTLNAGDTATDTTVNGGLFTARGGSLAGTTTLNNGATFTLAGKTVNNDTLTIREGDALLQGGALTGNGRVEKSGSGTLTVSNTTLTQKAVNLNEGTLTLNDSTVTTDIIAHRGTALKLTGSTVLNGAIDPTNVTLTSGATWNIPDNATVQSVVDDLSHAGQIHFTSARTGKFVPTTLQVKNLNGQNGTISLRVRPDMAQNNADRLVIDGGRATGKTILNLVNAGNSGTGLATTGKGIQVVEAINGATTEEGAFVQGNMLQAGAFNYTLNRDSDESWYLRSEERYRAEVPLYASMLTQAMDYDRILAGSRSHQTGVNGENNSVRLSIQGGHLGHDNNGGIARGATPESSGSYGFVRLEGDLLRTEVAGMSLTTGVYGAAGHSSVDVKDDDGSRAGTVRDDAGSLGGYMNLTHTSSGLWADIVAQGTRHSMKASSDNNDFRARGRGWLGSLETGLPFSITDNLMLEPRLQYTWQGLSLDDGKDNAGYVKFGHGSAQHVRAGFRLGSHNDMTFGEGTSSRAPLRDSAKHSVRELPVNWWVQPSVIRTFSSRGDMRVGTSTAGSGMTFSPSQNGTSLDLQAGLEARVRENITLGVQAGYAHSINGSSAEGYNSQATLNVTF

SEQ ID NO: 39 - protein, 1039 aa, Escherichia coli
MKRHLNTCYRLVWNHITGAFVVASELARARGKRGGVAVALSLAAVTSLPVLAADIVVHPGETVNGGTLVNHDNQFVSGTADGVTVSTGLELGPDSDDNTGGQQIARGGTARNTTVTANGLQDVMAGGSATDTVISAGGGQNLRGQAYGTVLNGGEQWIHAGGSASGTVINQSGYQTIKHGGQATGTIVNTGAEGGPESENVSSGQMVGGTAESTTINKNGRQVIWSSGMARDTLIYAGGDQTVHGEAHNTRLEGGNQYVHKYGLALNTVINEGGWQVIKEGGTTAHTTINQKGKLQVNAGGKASDVTQNTGGALVTSTAATVTGTNRLGAFSVLAGKADNVVLENGGRLDVLSGHTATNTRVDDGGTLDVRNGGAATTVSMGNGGVLLADSGAAVSGTRSDGTAFRIGGGQADALMLEKGSSFTLNAGDTATDTTVNGGLFTARGGSLAGTTTLNNGATLTLSGKTVNNDTLTIREGDALLQGGALTGNGRVEKSGSGTLTVSNTTLTQKTVNLNEGTLTLNDSTVTTDVIAQRGTALKLTGSTVLNGAIDPTNVTLTSGATWNIPDNATVQSVVDDLSHAGQIHFTSTRTGKFVPATLQVKNLNGQNGTISLRVRPDMAQNNADRLVIDGGRATGKTILNLVNAGNSGTGLATTGKGIQVVEAINGATTEEGAFVQGNMLQAGAFNYTLNRDSDESWYLRSEERYRAEVPLYASMLTQAMDYDRILAGSRSHQTGVNGENNSVRLSIQGGHLGHDNNGGIARGATPESSGSYGFVRLEGDLLRTEVAGMSLTTGVYGAAGHSSVDVKDDDGSRAGTVRDDAGSLGGYMNLTHTSSGLWADIVAQGTRHSMKASSGNNDFRARGWGWLGSLETGLPFSITDNLMLEPRLQYTWQGLSLDDGKDNAGYVKFGHGSAQHVRAGFRLGSHNDMTFGEGTSSRAPLRDSAKHSVRELPVNWWVQPSVIRTFSSRGDMRVGTSTAGSGMTFSPSQNGTSLDLQAGLEARVRENITLGVQAGYAHSVSGSSAEGYNSQATLNVTF

SEQ ID NO: 40 - protein, 1040 aa, Escherichia coli
MKRHLNTCYRLVWNHITGAFVVASELARARGKRGGVAVALSLAAVTPLPVLSADIVVHPGETVNGGTLVNHDNQFVSGTANGVTVSTGLELGPDSDENTGGQWIKAGGTGRNTTVTANGRQIVQAGGTASDTVIRDGGGQSLNGLAVNTTLDNRGEQWVHGGGKAAGTIINQDGYQTIKHGGLATGTIVNTGAEGGPESENVSSGQMVGGTAESTTINKNGRQVIWSSGMARDTLIYAGGDQTVHGEAHNTRLEGGNQYVHNGGTATETLINRDGWQVIKEGGTAAHTTINQKGKLQVNAGGKASDVTQNTGGALVTSTAATVTGTNRLGAFSVVAGKADNVVLENGGRLDVLSGHTATNTRVDDGGTLDIRNGGAATTVSMGNGGVLLADSGAAVSGTRSDGKAFSIGGGQADALMLEKGSSFTLNAGDTATDTTVNGGLFTARGGTLAGTTTLNNGAILTLSGKTVNNDTLTIREGDALLQGGSLTGNGSVEKSGSGTLTVSNTTLTQKAVNLNEGTLTLNDSTVTTDVIAQRGTALKLTGSTVLNGAIDPTNVTLASDATWNIPDNATVQSVVDDLSHAGQIHFTSSRTGTFVPATLKVKNLNGQNGTISLRVRPDMAQNNADRLVIDGGRATGKTILNLVNAGNSASGLATSGKGIQVVEAINGATTEEGAFVQGNRLQAGAFNYSLNRDSDESWYLRSENAYRAEVPLYASMLTQAMDYDRILAGSRSHQTGVNGENNSVRLSIQGGHLGHDNNGGIARGATPESSGSYGFVRLEGDLLRTDVAGMSVTAGIYGAAGHSSVDVKDDDGSRAGTVRDDAGSLGGYMNLTHTSSGLWADIVAQGTRHSMKASSGNNDFRARGRGWLGSLETGLPFSITDNLMLEPRLQYTWQGLSLDDGKDNAGYVKFGHGSAQHVRAGFRLGSHNDMTFGEGTSSRAPLRDSAKHSVRELPVNWWVQPSVIRTFSSRGDMRVGTSTAGSGMTFSPSQNGTSLDLQAGLEARVRENITLGVQAGYAHSVSGSSAEGYNGQATLNVTF

SEQ ID NO: 41 - protein, 457 aa, Escherichia coli
MLRRSLIFLVLLSAGCVSLDPHYSTPESPIPATLPGAQGQGKAISHDWQQVIHDPRLQQVVTIALNSNRDVQKAIADIDSARALYGQTNASLFPTVNAALSSTRSRSLANGTGTTAEADGTVSSYTLDLFGRNQSLSRAARETWLASEFTAQNTRLTLIAEISTAWLTLAADNSNLALAKETMASAENSLKIIQRQQQVGTAAATDVSEAMSVYQQARASVASYQTQVMQDKNALNLLAGTTLAENLLPGTLESLPEQMISLVPAGVSSDVLLRRPDIQEAEHNLKSANADIGAARANFFPTISLTASAGVGSDALSSLFSHGMQIWSFAPSVTLPLFTGGSNLAQLRYAEAQKRGLIATYEKTVQSAFKDVANALARRTTLEEQLDAQRQYVKAEQQTVDVGLRRYQAGVGDYLTVLTAQRSLWSAQQELLALQLTDFTNRITLWQSLGGGMSSLK

SEQ ID NO: 42 - protein, 457 aa, Escherichia coli; identical to SEQ ID NO: 41

SEQ ID NO: 43 - protein, 457 aa, Escherichia coli; identical to SEQ ID NO: 41

SEQ ID NO: 44 - protein, 457 aa, Escherichia coli
MLRRSLIFLVLLSAGCVSLDPHYSTPESPIPATLPGAQGQGKAISHDWQQVIHDPRLQQVVTIALNSNRDVQKAIADIDSARALYGQTNASLFPTVNAALSSTRSRSLANGTVTTAEADGTVSSYTLDLFGRNQSLSRAARETWLASEFTAQNTRLTLIAEISTAWLTLAADNSNLALAKETMASAENSLKIIQRQQQVGTAAATDVSEAMSVYQQARASVASYQTQVMQDKNALNLLAGTTLAENLLPGTLESLPEQMISLVPAGVSSDVLLRRPDIQEAEHNLKSANADIGAARANFFPTISLTASAGVGSDALSSLFSHGMQIWSFAPSVTLPLFTGGSNLAQLRYAEAQKRGLIATYEKTVQSAFKDVANALARRTTLEEQLDAQRQYVKAEQQTVDVGLRRYQAGVGDYLTVLTAQRSLWSAQQELLALQLTDFTNRITLWQSLGGGMSSLK

SEQ ID NO: 45 - protein, 457 aa, Escherichia coli
MLRRSLIFLVLLSAGCVSLDPHYSTPESPIPATLPGAQGQGKAISHDWQQVIHDPRLQQVVTIALNRNRDVQKAIADIDSARALYGQTNASLFPTVNAALSSTRSRSLANGTGTTAEADGTVSSYTLDLFGRNQSLSRAARETWLASEFTAQNTRLTLIAEISTAWLTLAADNSNLALAKETMASAENSLKIIQRQQQVGTAAATDVSEAMSVYQQARASVASYQTQVMQDKNALNLLAGTTLAENLLPGTLESLPEQMISLVPAGVSSDVLLRRPDIQEAEHNLKSANADIGAARANFFPTISLTASAGVGSDALSSLFSHGMQIWSFAPSVTLPLFTGGSNLAQLRYAEAQKRGLIATYEKNVQSAFKDVANALARRTTLEEQLDAQRQYVKAEQQTVDVGLRRYQAGVGDYLTVLTAQRSLWSAQQELLALQLTDFTNRITLWQSLGGGMSSLK

SEQ ID NO: 46 - protein, 457 aa, Escherichia coli
MLRRSLIFLVLLSAGCVSLDPHYSTPESPIPATLPGAQGQGKAISHDWQQVIHDPRLQQVVTIALNSNRDVQKAIADIDSARALYGQTNASLFPTVNAALSSTRSRSLANGTGTTAEADGTVSSYTLDLFGRNQSLSRAARETWLASEFTAQSTRLTLIAEISTAWLTLAADNSNLALAKETMASAENSLKIIQRQQQVGTAAATDVSEAMSVYQQARASVASYQTQVMQDKNALNLLAGTTLAENLLPGTLESLPEQMISLVPAGVSSDVLLRRPDIQEAEHNLKSANADIGAARANFFPTISLTASAGVGSDALSSLFSHGMQIWSFAPSVTLPLFTGGSNLAQLRYAEAQKRGLIATYEKTVQSAFKEVANALARRTTLEEQLDAQSQYVKAEQQTVDVGLRRYQAGVGDYLTVLTAQRSLWSAQQELLALQLTDFTNRITLWQSLGGGMSSLK

SEQ ID NO: 47 - protein, 457 aa, Escherichia coli
MLRRSLIFLVLLSAGCVSLDPHYSTPESPIPATLPGAQGQGKAISHDWQQVIHDPRLQQVVTIALNSNRDVQKAIADIDSARALYGQTNASLFPTVNAALSSTRSRSLANGTETTAEADGTVSSFTLDLFGRNQSLSRAARETWLASEFTAQNTRLTLIAEISTAWLTLAADNSNLALAKETMTSAENSLKIIQRQQQVGTAAATDVSEAMSVYQQARASVASYQTQVMQDKNALNLLAGTTLEENLLPGTLESLPEQMISLVPAGVSSDVLLRRPDIQEAEHNLKSANADIGAARANFFPTISLTASAGVGSDALSSLFSHGMQIWSFTPSVTLPLFTGGSNLAQLRYAEAQKRGLIATYEKTVQRAFKDVANALARRTTLEEQLDAQRQYVKAEQQTVDVGLRRYQTGVGDYLTVLTAQRSLWSAQQELLALQLTDFTNRITLWQSLGGGMSSLK

SEQ ID NO: 48 - protein, 325 aa, Escherichia coli
MITLPPKRGMALVVVLVLLAVMMLVTITLSGRMQQQLGRTRSQQEYQQALWYSASAESLALSALSLSLKNEKRVHLAQPWASGPRFFPLPQGQIAVTLRDAQACFNLNALAQPTTASRPIAVQQLIALISRLDVPAYRAELIAESLWEFIDEDRSVQTRLGREDSEYLARSVPFYAANQPLADISEMRVVQGMDAGLYQKLKPLVCALPMARQQININTLDVTQSVILEALFDPWLSPVQARALLQQRPAKGWEDVDQFLAQPLLADVDERTKKQLKTVLSVDSNYFWLRSDITVNEIELTMNSLIVRMGPQHFSVLWHQTGESE

SEQ ID NO: 49 - protein, 325 aa, Escherichia coli
MITLPPKRGMALVVVLVLLAVMMLVTITLSGRMQQQLGRTRSQQEYQQALWYSASAESLALSALSLSLKNEKRVHLAQPWASGPRFFPLPQGQIAVTLRDAQACFNLNALAQPTTTSRPLAVQQLIALISRLDVPAYRAELIAESLWEFIDEDRSVQTRLGREDSEYLARSVPFYAANQPLADISEMRVVQGMDAGLYQKLKPLVCALPMARQQININTLDVTQSVILEALFDPWLSPVQARALLQQRPAKGWEDVDQFLAQPLLADVDERTKKQLKTILSVDSNYFWLRSDITVNEIELTMNSLIVRMGPQHFSVLWHQTGESE

SEQ ID NO: 50 - protein, 325 aa, Escherichia coli
MITSPPKRGMALVVVLVLLAVMMLVTITLSGRMQQQLGRTRSQQEYQQALWYSASAESLALSALSLSLKNEKRVHLEQPWASGPRFFPLPQGQIAVTLRDAQACFNLNALAQPTTASRPLAVQQLIALITRLDVPAYRAELIAESLWEFIDEDRSVQTRLGREDSEYLARSVPFYAANQPLADISEMRVVQGMDAGLYQKLKPLVCALPMTRQQININTLDVTQSVILEALFDPWLSPVQARALLQQRPAKGWEDVDQFLAQPLLADVDERTKKQLKTVLSVDSNYFWLRSDITVNEIELTMNSLIVRMGPQHFSVLWHQTGESE

SEQ ID NO: 51 - protein, 325 aa, Escherichia coli; identical to SEQ ID NO: 50

SEQ ID NO: 52 - protein, 325 aa, Escherichia coli
MITSPPKRGMALVVVLVLLAVMMLVIITLSGRMQQQLGRTRSQQEYQQALWYSASAESLALSALSLSLKNEKRVHLEQPWASGPRFFPLPQGQIAVTLRDAQACFNLNALAQPTTASRPLAVQQLIALISRLDVPAYRAELIAESLWEFIDEDRSVQTRLGREDSEYLARSVPFYAANQPLADISEMRVVQGMDAGLYQKLKPLVCALPMTRQQININTLDVTQSVILEALFDPWLSPVQARALLQQRPAKGWEDVDQFLAQPLLADVDERTKKQLKTVLSVDSNYFWLRSDITVNEIELTMNSLIVRMGPQHFSVLWHQTGESE

SEQ ID NO: 53 - protein, 325 aa, Escherichia coli
MITSPPKRGMALVVVLVLLAVMMLVTITLSGRMQQQLGRTRSQQEYQQALWYSASAESLALSALSLSLKNEKRVHLAQPWTSGPRFFPLPQGQIAVTLRDAQACFNLNALAQPTTASRPLAVQQLIALISRLDVPAYRAELIAESLWEFIDEDRSVQTRLGREDSEYLARSVPFYAANQPLADISEMRVVQGMDAGLYQKLKPLVCALPMTRQQININTLDVTQSVILEALFDPWLSPVQARALLQQRPAKGWEDVDQFLAQPLLADVDERTKKQLKTVLSVDSNYFWLRSDITVNEIELTMNSLIVRMGPQHFSVLWHQTGESE

SEQ ID NO: 54 - protein, 325 aa, Escherichia coli
MITSPPKRGMALVVVLVLLAVMMLVTITLSGRMQQQLGRTRSQQEYQQALWYSASAESLALSALSLSLKNEKRVHLAQPWASGPRFFPLPQGQIAVTLRDAQACFNLNALAQPTTASRPLAVQQLIALISRLDVPAYRAELIAESLWEFIDEDRSVQTRLGREDSEYLARSVPFYAANQPLADISEMRVVQGMDAGLYQKLKPLVCALPMTRQQININTLDVTQSVILEALFDPWLSPVQARALLQQRPAKGWEDVDQFLAQPLLADVDERTKKQLKTVLSVDSNYFWLRSDITVNEIELTMNSLIVRMGPQHFSVLWHQTGESE

SEQ ID NO: 55 - protein, 325 aa, Escherichia coli
MITSPPKRGMALVVVLVLLAVMMLVTITLSSRMQQQLGRTRSQQEYQQALWYSASAESLALSALSLSLKNEKRVHLAQPWASGPRFFPLPQGQIAVTLRDAQACFNLNALAQPTTASRPLAVQQLIALISRLDVPAYRAELIAESLWEFIDEDRSVQTRLGREDSEYLARSVPFYAANQPLADISEMRVVQGMDAGLYQKLKPLVCALPMARQQININTLDVTQSVILEALFDPWLSPVQARALLQQRPAKGWEDVDQFLAQPLLADVDERTKKQLKTILSVDSNYFWLRSDITVNEIELTMNSLIVRMGPQHFSVLWHQTGESE

SEQ ID NO: 56 - protein, 325 aa, Escherichia coli
MITSPPKRGMALVVVLVLLAVMMLVTITLSGRMQQQLGRTRSQQEYQQALWYSASAESLALSALSLSLKNEKRVHLAQPWASGPRFFPLPQGQIAVTLRDAQACFNLNALAQPTTASRPLAVQQLIALISRLDVPAYRAELIAESLWEFIDEDRSVQTRLGREDSEYLARSVPFYAANQPLADISEMRVVQGMDAGLYQKLKPLVCALPMARQQININTLDVTQSVILEALFDPWLSPVQARALLQQRPAKGWEDVDQFLAQPLLADVDERTKKQLKTILSVDSNYFWLRSDITVNEIELTMNSLIVRMGPQHFSVLWHQTGESE

SEQ ID NO: 57 - protein, 325 aa, Escherichia coli
MITSPPKRGMALVVVLVLLAVMMLVTITLSGRMQQQLGRTRSQQEYQQALWYSASAESLALSALSLSLKNEKRVHLTQPWASGPRFFPLPQGQIAVTLRDAQACFNLNALAQPTTASRPLAVQQLIALISRLDVPAYRAELIAESLWEFIDEDRSVQTRLGREDSEYLARSVPFYAANQPLADISEMRVVQGMDDGLYQKLKPLVCALPMTRQQININTLDVTQSVLLEALFDPWLSPVQARALLQQRPAKGWEDVDQFLAQPLLADVDERTKKQLKTVLSVDSNYFWLRSDITVNEIELTMNSLIVRMGPQHFSVLWHQTGESE

SEQ ID NO: 58 - protein, 325 aa, Escherichia coli
MITSPPKRGMALVVVLVLLAVIMLVTITLSGRMQQQLGRTRSQQEYQLALWYSASAESLALSALSLSLKNEKRVHLAQPWASGPRFFPLPQGQIAVTLRDAQACFNLNALAQPTTASRPLAVQQLISLISRLDVPAYRAELIAESLWEFIDEDRSVQTRLGREDSEYLARSVPFYAANQPLADISEMRVVQGMDAGLYQKLKPLVCALPMARQQININTLDVTQSVILEALFDPWLSPVQARALLQQRPAKGWEDVDQFLAQPLLADVDERTKKQLKTILSVDSNYFWLRSDITVNEIELTMNSLIIRMGPQHFSVLWHQTGESE

SEQ ID NO: 59 - protein, 325 aa, Escherichia coli
MITLPPKRGMALVVVLVLLAVMMLVTITLSGRMQQQLGRTRSQQEYQQALWYSASAESLALSALSLSLKNEKRVHLAQPWASGPRFFPLPQGQIAVTLRDAQACFNLNALAQPTTASRPLAVQQLIALITRLGVPAYRAELIAESLWEFIDEDRSVQTRLGREDSEYLARSVPFYAANQPLADISEMRVVQGMDAGLYQKLKPLVCALPMTRQQININTLDVTQSVILEALFDPWLSPVQARALLQQRPAKGWEDVDQFLAQPLLADVDERTKKQLKTVLSVDSNYFWLRSDITVNEIELTMNSLIVRMGSQHFSVIWHQTGESE

SEQ ID NO: 60 - protein, 325 aa, Escherichia coli
MIISPPKRGMALAVVLVLLAVMMLVTITLSARMQQQLGRTRSQQEYQQALWYSASAESLALSALSLSLKNEKRVHLAQPWASGPRFFPLPQGQIAVTLRDAQACFNLNALAQPTTATRPLAVQQLIALITRLDVPAYRAELIAESLWEFIDEDRSIQTRLGREDSEYLARSVPFYAANQPLADISEMRVVQGMDAGLYQKLKPLVCALPMARQQININTLDVTQSVILEALFDPWLSPVQARALLQQRPAKGWEDVDQFLAQPLLADVDDRTKKQLKTVLSVDSNYFWLRSDITVNEIELTMNSLIVRMGPQHFSVLWHQTGESE

SEQ ID NO: 61 - protein, 187 aa, Escherichia coli
MLVAIAIFASLALMAQQVTNGVTRVNSAVAGHDQKLNLMQQTMSFLTHDLTQMMPRPVRGDQGQREPALLAGAGVLASESEGMRFVRGGVVNPLMRLPRSNLLTVGYRIHDGYLERLAWPLTDAAGSVKPTMQKLIPADSLRLQFYDGTRWQESWSSVQAIPVAVRMTLHSPQWGEIERIWLLRGPQ

SEQ ID NO: 62 - protein, 189 aa, Escherichia coli
MLVAIAIFASLALMAQQVTNGVTRVNNAVAGHDQKLNLMQQTMSFLTHDLTQMMPRPVRGEQGQREPALLAGAGVLASESEGMRFVRGGVVNPLMRLPRSNLLTVGYRIHDGYLERLAWPLTDAAGSVKPTMQKLIPADSLRLQFYDGTRWQESWSSVQAIPVAVRMTLHSPQWGEIERIWLLRGPQLS

SEQ ID NO: 63 - protein, 187 aa, Escherichia coli
MLVAIAIFASLALMAQQVTNGVTRVNSAVADHDQKLNLMQQTMSFLTHDLTQMMPRPVRGDQGQREPALLAGAGVLASESEGMRFVRGGVVNPLMRLPRSNLLTVGYRIHDGYLERLAWPLTDAAGSVKPTMQKLIPADSLRLQFYDGTRWQESWSSVQAIPVAVRMTLHSPQWGEIERIWLLRGPQ

SEQ ID NO: 64 - protein, 189 aa, Escherichia coli
MLVAIAIFASLALMAQQVTNGVTRVNSAVAGHDQKLNLMQQTMSFLTHDLTQMMPRPVRGDQGQREPALLAGAGVLASESEGMRFVRGGVVNPLMRMPRSNLLTVGYRIHDGYLERLSWPLTDAAGSVKPTMQKLIPADSLHLQFYDGTRWQESWSSVQAIPVAVRMTLHSPQWGEIERIWLLRGPQLS

SEQ ID NO: 65 - protein, 189 aa, Escherichia coli
MLVAIAIFASLALMAQQVTNGVTRVNSAVAGHDQKLNLMQQTMSFLTHDLTQMMPRPVRGDQGQREPALLAGAGVLVSESGGMRFVRGGVVNPLMRLPRSNLLTVGYRIHDGYLERLAWPLTDAAGSVKPTTQKLIPADSLRLQFYDGTRWQESWSSVQAIPVAVRITLHSPQWGEIERIWLLRGPQLS

SEQ ID NO: 66 - protein, 189 aa, Escherichia coli
MLVAIAIFASLALMAQQVTNGVTRVNSAVAGHDQKLNLMQQTMSFLNHDLTQMMPRPVRGDQGQREPALLAGAGVLASESEGMRFVRGGVVNPLMRLPRSNLLTVGYRIHGGYLERLAWPLTDAAGSVKPTTQKLIPADSLRLQFHDGTRWQESWSSVQAIPVAVRITLHSPQWGEIERIWLLRGPQLS

SEQ ID NO: 67 - protein, 189 aa, Escherichia coli; identical to SEQ ID NO: 66

SEQ ID NO: 68 - protein, 189 aa, Escherichia coli
MLVAIAIFASLALMAQQVTNGVTRVNSAVAGHDQKLNLMQQTMSFLNHDLTQMMPRPVRGDQGQREPALLAGAGVLASESEGMRFVRGGVVNPLMRLPRSNLLTVGYRIHGGYLERLAWPLTDAAGSVKPTTQKLIPADSLRLQFYDGTRWQESWSSVQAVPVAVRITLHSPQWGEIERIWLLRGPQLS

SEQ ID NO: 69 - protein, 189 aa, Escherichia coli
MLVAIAIFASLALMAQQVTNGVTRVNSAVAGHDQKLNLMQQTMSFLNHDLTQMMPRPVRGDQGQREPALLAGAGVLASESEGIRFVRGGVVNPLMRLPRSNLLTVGYRIHGGYLERLAWPLTDAAGSVKPTTQKLIPADSLRLQFHDGTCWQESWSSVQAIPVAVRITLHSPQWGEIERIWLLRGPQLS

SEQ ID NO: 70 - protein, 189 aa, Escherichia coli
MLVAIAIFALLALMAQQVTNGVTRVNSAVAGHDQKLNLMQQTMSFLTHDLTQMMPRPVRGDQGQREPALLAGAGVLASESGGMRFVRGGVVNLLMRLPRSNLLTVGYRIHGGYLERLAWPLTDAAGSVKPTTQKLIPADSLRLQFHDGTRWQESWSSVQAIPVAVRITLHSPQWGEIERIWLLRGPQLS

SEQ ID NO: 71 - protein, 189 aa, Escherichia coli
MLVAIAIFASLALMAQQVTNGVTRVNSAIGEHDQKLNLMQQTMSFLTHDLTQMMPRPVRGDQGQREPALLAGPGVLASESEGMRFVRGGVVNPLMRLPRSNLLTVGYRIHGGYLERLAWPLTDAADSVKPTTQKLIPADSLRLQFYDGTRWQESWSSVQAIPVAVRMTLHSPQWGEIERIWLLRGPQLS

SEQ ID NO: 72 - protein, 713 aa, Escherichia coli
MAMFTPSFSGLKGRALFSLLFAAPMIHATDSVTTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESVGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 73 - protein, 713 aa, Escherichia coli
MAMFTPSFSGLKGRALFSLLFAAPMIHATDSVTTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESVGDETIAKTAGRVRSRGVEVDLAGALTENINIIASYGYTDAKVLEDPDYAGKPLPNIPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 74 - protein, 713 aa, Escherichia coli
MAMFTPSFSGLKGRALFSLLFAAPMIHATDSVTTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQENYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 75 - protein, 713 aa, Escherichia coli
MAMFTPSFSGLKGRALFSLLFAAPMIHATDSVTTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGKSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESVGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 76 - protein, 713 aa, Escherichia coli
MAKFTPSFSGIKGRALFSLLFAAPMIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHSTRADLQGNVDIAGFYNEILGGVSYEYYDLLRTDMIRCKNAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 77 - protein, 713 aa, Escherichia coli; identical to SEQ ID NO: 76

SEQ ID NO: 78 - protein, 713 aa, Escherichia coli
MAKFTPSFSGIKGRALFSLLFAAPMIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHSTRADLQGNVDIAGFYNEILGGVSYEYYDLLRTDMIRCKNAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESIGDETIAKTAGRVRSRGVEVDLAGALTENINIIASYGYTDAKVLEDPDYAGKPLPNVPRHTGSLFLTYDIHNMPGNNTLTFGGGGHCVSRRSATNGADYYLPGYFVADAFAAYKMKLQYPVTLQLNVKNLFDKTYYTSSIATNNLGNQIGDPREVQFTVKMEF

SEQ ID NO: 79 - protein, 713 aa, Escherichia coli
MAKFTPSFSGIKGRALFSLLFAAPMIHATDTATTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDGQSDLAQLNAEYHLNSQWTARFDYSYSQDKYSDNQARVTAYDATTGTLTRRVDATQGSTQRMHATRADLQGNVDIAGFYNEILGGVSYEYYDLLRTDMIRCKKAKDFNIYNPVYGNTSKCTTVSASDSDQTIKQESYSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTESVGDETIAKTAGRVRSRGVEVDLAGALTENINIIASYGYTDAKVLEDPDYAGKPLPNVPRHTGSLFLTYDIHNMPGNNTLTFGGGGHGVSRRSATNGADYYLPGYFVADAFAAYKMKLQYPVTLQLNVKNLFDKTYYTSSIATNNLGNQIGDPREVQFTVKMEF

SEQ ID NO: 80 - protein, 187 aa, Escherichia coli
MLKKTLLSMFATALLSGVAFNALADDANQGSGKITFKGEVIDAPCSIAPGDEDQTINLGEVADTVLKSGQKSLPVDVTIHLQDCILSDGTNTVDKVKITFSSASVDATDSNLLKNTLEGNIGGATDVGVRLVKSDNTNVTLGTPITINFPTTNSYQELNFKARMESLGRTATPGNVQAQANYVLDYK

SEQ ID NO: 81 - protein, 187 aa, Escherichia coli
MFKKTLLSMFATALLSGVAFNALADDANQGSGKITFKGEVIDAPCSIAPGDEDQTINLGEVADTVLKSGQKSLPVDVTIHLQDCILSDGTNTVDKVKITFSSASVDATDSNLLKNTLEGNIGGATDVGVRLVKSDNTNVTLGTPITINFPTTNSYQELNFKARMESLGRTATPGNVQAQANYVLDYK

SEQ ID NO: 82 - protein, 151 aa, Escherichia coli
VSLSTALRMTCRRRLLSLIVGPASLNRFIPPFQHFGQRHNVSNGWRPVKNGGDICHQIVNRQAVGKPASTDFFNKKVTTSTDMAVRSAGSISAISCAVSAGLEMRGITVIIAFTSISIMACRRVPRSAPDCGLRSTISVISVLPRLMGVSS

SEQ ID NO: 83 - protein, 151 aa, Escherichia coli
VSLSTALRMTCRRRLLSLIVGPASLNRFIPPFQHFGQRHNVSNGWRPVKDGGDICHQIVNRQAVGKPASTDFFNKKVTTSTDMAVRSAGSISAISCAVSAGLEMRGITVIIAFTSISIMACRRVPRSAPDCGLRSTISVISVLPRMMGVSS

SEQ ID NO: 84 - protein, 151 aa, Escherichia coli
VSLSTALRMTCRRRLLSLIVGPASLNRFIPPVQHFGQRHNVSNGWRPVKNGGDICHQIVNRQAVGKPASTDFFNKKVTTSTDMAVRSAGSISAISCAVSAGLEMRGITVIIAFTSISIMACRRVPRSAPDCGLRSTISVISVLPRMMGVSS

SEQ ID NO: 85 - protein, 151 aa, Escherichia coli
MIHLFKTCMITTFILGLMWSAPLRAQDQRYISIRNTDTIWLPGNICAYQFRLDNGGNDEGFGPLTITLQLKDKYGQTLVTRKMETEAFGDSNATRTTDAFLETECVENVATTEIIKATEESNGHRVSLPLSVFDPQDYHPLLITVSGKNVN

SEQ ID NO: 86 - protein, 151 aa, Escherichia coli
MIHLFKTCMITTFILGLMWSAPLRAQDQRYISIRNTDTIWLPGNICAYQFRLDNGGNDEGFGPLTITLQLKDKYGQTLVTRKMETEAFGDSNATRTTDAFLETECVENVATTEIIKATEESNGHRVSLPLSVFNPQDYHPLLITVSGKNVN

SEQ ID NO: 87 - protein, 151 aa, Escherichia coli
MIHLFKTCMITAFILGLTWSAPLRAQDQRYISIRNTDTIWLPGNICAYQFRLDNGGNDEGFGPLTITLQLKDKYGQTLVTRKMETEAFGDSNATRTTDAFLETECVENVATTEIIKATEESNGHRVSLPLSVFNPQDYHPLLITVSGKNVN

SEQ ID NO: 88 - protein, 151 aa, Escherichia coli; identical to SEQ ID NO: 87

SEQ ID NO: 89 - protein, 151 aa, Escherichia coli
MIHLFKTCMITAFILGLTWSAPLRAQDQRYISIRNTDTIWLPGNICAYQFRLDNGGNDEGFGPLTITLQLKDKYGQTLVTRKMETEAFGDSNATRTTDAFLETECVENVATTEIIKATEESNGHRVSLPLSVFDPQDYHPLLITVSGKNVN

SEQ ID NO: 90 - protein, 151 aa, Escherichia coli; identical to SEQ ID NO: 89

SEQ ID NO: 91 - protein, 151 aa, Escherichia coli; identical to SEQ ID NO: 89

SEQ ID NO: 92 - protein, 187 aa, Escherichia coli
MKLKHVGMIVVSVLAMSSAAVSAAEGDESVTTTVNGGVIHFKGEVVNAACAIDSESMNQTVELGQVRSSRLAKAGDLSSAVGFNIKLNDCDTNVSSNAAVAFLGTTVTSNDDTLALQSSAAGSAQNVGIQILDRTGEVLILDGATFSAKTDLIDGTNILPFQARYIALGQSVAGTANADATFKVQYL

SEQ ID NO: 93 - protein, 187 aa, Escherichia coli; identical to SEQ ID NO: 92

SEQ ID NO: 94 - protein, 187 aa, Escherichia coli; identical to SEQ ID NO: 92

SEQ ID NO: 95 - protein, 187 aa, Escherichia coli
MKLKHVGMIVVSVLAMSSAAVSAAEGDESVTTTVNGGVIHFKGEVVNAACAIDSESMNQTVELGQVRSSRLAKAGDLSSAVGFNIKLNDCDTNVSSNAAVAFLGTTVTSNDDTLALQSSAAGSAQNVGIQILDRTGEVLILDGGTFSAKTDLIDGTNILPFQARYIALGQSVAGTANADATFKVQYL

SEQ ID NO: 96 - protein, 187 aa, Escherichia coli
MKLKHVGIIVVSVLAMSSAAVSAAEGDESVTTTVNGGVIHFKGEVVNAACAIDSESMNQTVELGQVRSSRLAKAGDLSSAVGFNIKLNDCDTNVSSNAAVAFLGTTVTSNDDTLALQSSAAGSAQNVGIQILDRTGEVLVLDGATFSAKTDLIDGTNILPFQARYIALGQSVAGTANADATFKVQYL

SEQ ID NO: 97 - protein, 187 aa, Escherichia coli
MKLKHVGIIVVSVLAMSSAAVSAAEGDESVTTTVNGGVIHFKGEVVNAACAIDSESMNQTVELGQVRSSRLAKAGDLSSAVGFNIKLNDCDTNVSSNAAVAFLGTTVTSNDDTLALQSSAAGSAQNVGIQILDSTGEVLVLDGATFSAKTDLIDGTNILPFQARYIALGQSVAGTANADATFKVQYL

SEQ ID NO: 98 - protein, 187 aa, Escherichia coli
MKLKHVGIIVVSVLAMSSAAVSAAEGDESVMTTVNGGVIHFKGEVVNAACAIDSESMNQTVELGQVRSSRLAKAGDLSSAVGFNIKLNDCDTNVSSNAAVAFLGTTVTSNDDTLALQSSAAGSAQNVGIQILDRTGEVLVLDGATFSAKTDLIDGTNILSFQARYIALGQSVAGTANADATFKVQYL

SEQ ID NO: 99 - protein, 2649 aa, Escherichia coli
MNKVYKVIWNHTTQKWDVVSELTSCRKKCKSTRLGIALSAMVLGGAIAINCNNAMADVILSPDWRPGTNNSGVGAATVSGKTEYITGPNVVQSGGSGLIWMTVEQAILNGYTTGDNLSGLIYVNTGEKTKTITVKDEVTGASQTLQVFDTDSFSQRDAGTGGNETIPGFSGTADFFNATRFVTANNGGTAILDVGSPAIGNFFKNTQLAVADGEGSSVVWNSVNDFYFQPGATMQGGGVTQKIIDSMKYAGTITDWAGKVHHINSLDDLKQYNQYLIKSLEDKTLSYKQYDAEFNKALIVTKHNYNVDMTAGGRIDSTPYKENVGLLAVLHATNNARAILGKTGKLTGVLPAYGNGGGIVATNGGTGVNEGVIDAIGTEMIAYQDSTIVNDGTLFVWDNNDKYALQAEGMVAGSNGSSAINNGVINIRPFKNAFAPEGINTAIVVSNGGMATNKGTINITADASTNDNNGKTRGVNVGAGGSFINSAFGSINVGIAEDKTATHSAVGSVAIEVQNGANKVVNEGTIFLGRGAQGNYGILAKDAGTVDVVNKGTITIDGHDSDAPALNVGMLANNSSGMKNSGIINVNGLNSTGLQVINAGQLNSDGTINVGGKGISSGFRNYGAWVEGAGSNVNVSGKISLAGTGAVGVFAKDGGSLTLSGNGAVLFGSSDQIGFYVYGKDSAIHNTGSGVMDVSTENSTLFRIASGATFQGTADASSALTASGKNSYALIATGKSDGGVASTVTSGGMTINLTGEGATATLIEGGAQGTIESNAIINMDNASAIAGIADGNGYDISGKLINPKDKTTLLTAGAQLSSTQDKVTGYIARNGATLNNTGNIIFTGKNTVGVRVEEGAVGTNSGNITVQDGGVGLIANATQDVTTINNSGNLVLKGGDNANRTTGIKASGTTTTVNMTAGTISLQGQGAIGVEASNKGTVNLDGSAVPNFAADGSGITDQIAFRIIGDGATIKTNIAPGTLLDASGERSVLFRIEDGAKQAGSLLMKTSGTGSRGIWATGKGSNVLADAGSDFQILGAQAQGLYVTGGATATLKQGASVNLVGDGAVVAEVDGNEYALDGSITQTNTGSVITNEADISSPLNNAKGFITRNQGLLINNGNIDFTTGTDNIGVWVDNGRFENTGSRIAVNGVALFVEGAQSQITSTGGDIVAVDGEAAIKLGAGASLNLAGSGLGTIEGQKNAHGILLDTGAVGLVIDGAKINVNAAGAVGHGIENRAEIEGIQLTNTTEINVADGIGVRTSASLAKTNSGTINVDGSGIALAFQKADGSETDNNLDMSDSAGLVINLKGTDGTGIFANTKDGAVVKSGASVNVIQADGGSALVVNNAASEVVQSGNLISASLSHAVVDASKAQSFTNKGQIKAASTTGTAMAFDDAVNTTVLNDSGAEIQGVVALNGGDNTFTNKGSITGTVSAKEGNNTFLFDDGSTLTGEVTAGNGNNNVTLNGKTHVDQVTAGTGKNTFTIKGEGATWNLLDGGQGDSDSLIFDNAIHTLDSVVKLQNFEHVGLKNSSLVTLKEALVLTDGGNGPGSVDIESGSELAIIPAVAGNFTFDPLLTGKGTLSARLDADTSAFEFSHNVGDQFAGTLKLGTSSFALEGLNTSGLTHAMLMSETGNITTVGSGVQQIGGLGFNGGTLIFGSVMPGDTIASNSIETSAAGTLDIRGKGTIQVTMPDEVINDIPAVDTRKNLLEQDDAQTLVTLVNAAGTVTGTGGQLQLVDENGQAISHSQTFDVTQGGEVVAQGNYDYKLLGSSDGIKGDGLYIGYGLKSLDLQGTGDKALVLTPRANAQGLQTDLGAQLTGAGDLAIEAAGQVVTLSNGGNNYTGDTLVRSGTLQMANDNVLGATGNLNVASNAVFRTNGYSQTVGALQTETGAHIQLDSGSVLTVSGTQRQPGDDNGGIIENNVLSGEGTLAVTGSNLTVHGTNIGFTGNASLTQGALVEMNGAQGLGSQGSISFESLNDRLAIDIADGSGVSSNLSKSLSGEGSVGILNTTDLTLSGDNSNFSGEFRVQKDAALRASDEKHLGTGLIDSDGVTWLTASGNWLLKNDITGSGALVKQGAGNLIINHELTYTGDTTVESGVLIVGDDSVTRAAGATLSGSKNIHVLNGGTLSGLGTVSGQVNNQGTLASLNALSGYETAEVGNFTVGSLTNTGVIRLAGGKTGNTLTVNGDYTGGGTLIINTVLGDDTSTTDKLIVTGNTSGDTGVVVNNVRGQGAQTADGIEIVHVGGQSDGNFRLQNRAVAGAWEYFLHKGNAGGTDGNWYLRSELPPEPQPQPQPQPQPQPQPQPQPQPQPQPHPTPDKPVQKVYRPEAGSYIANIAAANTLFNIRMHDREGETYYTDVFTGEKKATSMWMRHIGGHNRWKDSSSQLNTQSNRYVVQLGGSIAQWTDGQDRLQQGIMAGYGNEKSSTTSSLSGYKSKGAINGYSTGLYGTWQQNDGNDNGAYVDTWIQYGWFNNTVNGEKLAAESWKSRGFTGSVEAGYTFKAGEFTGSQGSHYDWYIQPQSQITWMNVRASEHTEKNGTKVQLSGDGNIQSRLGVRTYLKGKSASDDNKAHQFEPFVEVNWIHNTRSWGVKMDNTALSQDGATNIAEVKTGVQGKLSDNLNVWGNVGVQAGDKGYSDAQAMLGIKYIF

SEQ ID NO: 100 - protein, 2637 aa, Escherichia coli
MNKIYKVIWNHTTQKWDVVSELTSCRKKCKSTRLGIALSAMVLGGAIAINCNNAMADVILSPDWRPGTNNSGVGAATVSGKTEYITGPNVVQSGGSGLIWMTVEQAILNGYTTGDNLSGLIYVNTGEKTKTITVKDEVTGAYQTLQVFDTDSFSQRDAGTGGNETIPGFSGTADFFNATRFVTANNGGTAILDVGSPAIGNFFKNTQLAVADGEGSSVVWNSVNDFYFQPGATMQGGGVTQKIIDSMKYAGTITDWAGKVHHINSLDDLKQYNQYLIKSLEDKTLSYKQYDAEFNKALIVTKHNYNVDMTAGGRIDSTPYKENVGLLAVLHATNNARAILGKTGKLTGVLPAYGNGGGIVATNGGTGVNEGVIDAIGTEMIAYQDSTIVNDGTLFVWDNNDKYALQAEGMVAGSNGSSAINNGVINIRPFKNAFAPEGINTAIVVSNGGMATNKGTINITADASTNDNNGKTRGVNVGAGGSFINSAFGSINVGIAEDKTATHSAVGSVAIEVQNGANKVVNEGTIFLGRGAQGNYGILAKDAGSVDVVNKGTITIDGYDSDAPALNVGMLANNSSGMKNSGIINVNGLNSTGLQVINAGQLNSDGTINVGGEGISSGFRNYGAWVEGARSNVNVSGKINLSGTGAVGVFAKDGGSLTLSGNGAVLFGSSDQIGFYVYGKDSAIHNTGSGVMDVSTENSTLFRIASGATFQGTADASSALTASGKNSYALIATGKSDGGVASTVTSGGMTINLTGEGATATLIEGGAQGTIESNAIINMDNASAIAGIADGNGYDISGKLINPKDKTTLLTAGAQLSSTQDKVTGYIARNGATLNNTGNIIFTGKNTVGVRVEEGAVGTNSGNITVQDGGVGLIANATQDVTTINNSGNLVLKGGDNANRTTGIKASGTTTTVNMTAGTISLQGQGAIGVEASNKGTVNLDGSAVPNFASDGSGITDQIAFRIIGDGATIKTNIAPGTLLDASGERSVLFRIEDGAKQAGSLLMKTSGTGSRGIWATGKGSNVLADAGSDFQILGAQAQGLYVTGGATATLKQGASVNLVGDGAVVAEVDGNEYALDGSITQTNTGSVITNEADISSPLNNAKGFITRNQGLLINSGNIDFTTGTDNIGVWVDNGRFENTGSRIAVNGVALFVEGEHAQITSTGGDIVAVDGEAAIKLGAGASLNLAGSGLGTIEGQKNAHGILLDTGAVGLVIDGAKINVNAAGAVGHGIENRAEIEGIQLTNTTEINVADGIGVRTSASLAKTNSGTINVDGSGIALAFQKADGSETDNNLDMSDSGGLVINLKGTGGTGIFANTKDGAVVKSGASVNVTQADGGSALVVNNAASEVVQSGNLISASLSHAVVDASKAQSFTNKGQIKAASATGTAMAFDDAVNTTVLNDSGAEIQGVVALNGGDNTFTNKGSITGTVSAKEGNNTFLFDDGSILTGEVAAGNGNNNVTLNGKAHVDKVTAGTGKNTFTIKGEGATWNLLDGGQGDSDSLIFDNAIHTLDSAVKLRNFEHVGLKNSSLVTLKEALVLTDGGTGPGSVDIESGSELAIIPAVAGNFTFDPLLTGKGTLSARLDADTSAFEFSHNVGDQFAGTLKLGTSSFALEGLNTSGLTHAMLMSETGNITTVGSGVQQIGGLGFNGGTLIFGSVMPGDTIASNSIETSAAGTLDIRGKGTIQVTMPDEVINDIPAVDTRKNLLEQDDAQTLVTLVNAAGTVTGTGGQLQLVDENGQAISHSQTFDVTQGGEVVAQGNYDYKLLGSSDGVKGDGLYIGYGLKSLDLQGTGDKALVLTPRANAQGLQTDLGAQLTGAGDLAIEAAGQVVTLSNGGNNYTGDTLVRSGTLQMANDNVLGATGSLNVASNAVFRTDGYSQTVGALQTETGAHIQLDSGSVLTVSGTQRQPGDDNGGIIENNVLTGDGTLAVTGSNLTVHGTNIGFTGNVSLTRGSLVEMNGAQGLGSQGSISFESLNDRLAIDIADGSGVSSNLSKSLSGKGSVGILNTTDLTLSGDNRNFSGEFRVQKDAALRASDEKHLGTGLIDSDGVTWLTASGNWLLKNDITGSGALVKQGAGNLIINHELTYTGDTTVENGVLIVGDDSVTRAAGATLSGSKNIHVLNGGTLSGLGTVSGQVNNQGTLASLNALSGYETAEAGNFTVGSLTNTGVIRLAGGKTGNTLTVNGDYTGGGTLIINTVLGDDTSATDKLIVTGNTSGDTGVVVNNVRGQGAQTADGIEIVHVGGQSDGNFRLQNRAVAGAWEYFLHKGNAGGTDGNWYLRSELPPEPQPQPQPQPQPQPHPTPDKPVQKVYRPEAGSYIANIAAANTLFNIRMHDREGETYYTDVFTGEKKATSMWMRHIGGHNRWKDSSSQLNTQSNRYVVQLGGSIAQWTDGQDRLQLGIMAGYGNEKSSTTSSLSGYKSKGAINGYSTGLYGTWQQNDGNDNGAYVDTWIQYGWFNNTVNGEKLAAESWKSRGFTGSVEAGYTFKAGEFTGSQGSHYDWYIQPQSQITWMNVRASEHTEKNGTKVQLSGDGNIQSRLGVRTYLKGKSASDDNKAHQFEPFVEVNWIHNTRSWGVKMDNTALSQDGATNIAEVKTGVQGKLSDNLNVWGNVGVQAGDKGYSDAQAMLGIKYIF

SEQ ID NO: 101 - protein, 1024 aa, Escherichia coli
MPTITTAQIKSTLQSAKQSAANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNKLGGSAENIGDNLGKAGSVLSTFQNFLGTALSSMKIDELIKKQKSGSNVSSSELAKASIELINQLVDTAASINNNVNSFSQQLNKLGSVLSNTKHLNGVGNKLQNLPNLDNIGAGLDTVSGILSVISASFILSNADADTGTKAAAGVELTTKVLGNVGKGISQYIIAQRAAQGLSTSAAAAGLIASAVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKPDEFQKQVFDPLKGNIDLSDSKSSTLLKFVTPLLTPGEEIRERRQSGKYEYITELLVKGVDKWTVKGVQDKGSVYDYSNLIQHASVGNNQYREIRIESHLGDGDDKVFLAAGSANIYAGKGHDVVYYDKTDTGYLTIDGTKATEAGNYTVTRVLGGDVKVLQEVVKEQEVSVGKRTEKTQYRSYEFTHINGTDLTETDNLYSVEELIGTNRADKFFGSKFTDIFHGADGDDHIEGNDGNDRLYGDKGNDTLRGGNGDDQLYGGDGNDKLTGGVGNNYLNGGDGDDELQVQGNSLAKNVLSGGKGNDKLYGSEGADLLDGGEGNDLLKGGYGNDIYRYLSGYGHHIIDDDGGKDDKLSLADIDFRDVAFKREGNDLIMYKAEGNVLSIGHKNGITFRNWFEKESGDISNHQIEQIFDKDGRVITPDSLKKAFEYQQSNNQANYVYGEYASTYADLDNLNPLINEISKIISAAGNFDVKEERSAASLLQLSGNASDFSYGRNSITLTASA

SEQ ID NO: 102 - protein, 1024 aa, Escherichia coli
MPTITTAQIKSTLQSAKQSAANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNKLGGSAENIGDNLGKAGSVLSTFQNFLGTALSSMKIDELIKKQKSGGNVSSSELAKASIELINQLVDTAASLNNNVNSFSQQLNKLGSVLSNTKHLNGVGNKLQNLPNLDNIGAGLDTVSGILSAISASFILSNADADTGTKAAAGVELTTKVLGNVGKGISQYIIAQRAAQGLSTSAAAAGLIASVVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFEILSQYNKEYSVERSVLITQQHWDTLIGELAGVTRNGDKTLSGKSYIDYYEEGKRLEKEPDEFQKQVFDPLKGNIDLSVIKSSTLLKFITPLLTPGKEIRERRQSGKYEYITELLVKGVDKWTVKGVQDKGSVYDYSNLIQHASVGNNQYREIRIESHLGDGDDKVFLSAGSANIYAGKGHDVVYYDKTDTGYLTIDGTKATEAGNYTVTRVLGGDVKVLQEVVKEQEVSVGKRTEKTQYRSYEFTHINGTDLTETDNLYSVEELIGTNRADKFFGSKFTDIFHGADGDDHIEGNDGNDRLYGDKGNDTLRGGNGDDQLYGGDGNDKLTGGVGNNYLNGGDGDDELQVQGNSLAKNVLSGGKGNDKLYGSEGADLLDGGEGNDLLKGGYGNDIYRYLSGYGHHIIDDDGGKDDKLSLADIDFRDVAFKREGNDLIMYKAEGNVLSIGHKNGITFRNWFEKESGDISNHQIEQIFDKDGRVITPDSLKKAFEYQQSNNQANYVYGEYASTYADLDNLNPLINEISKIISAAGNFDVKEERSAASLLQLSGNASDFSYGRNSITLTASA

SEQ ID NO: 103 - protein, 1024 aa, Escherichia coli
MPTITTAQIKSTLQSAKQSSANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNKLGGSAENIGDNLGKAGSVLSTFQNFLGTALSSMKIDELIKRQKSGSNVSSSELAKASIELINQLVDTAASINNNVNSFSQQLNKLGSVLSNTKHLTGVGNKLQNLPNLDNIGAGLDTVSGILSAISASFILSNADADTGTKAAAGVELTTKVLGNVGKGISQYIIAQRAAQGLSTSAAAAGLIASVVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDTLIGELAGVTRNGDKTLSGKSYIDYYEEGKRLEKKPDEFQKQVFDPLKGNIDLSDSKSSTLLKFVTPLLTPGEEIRERRQSGKYEYITELLVKGVDKWTVKGVQDKGSVYDYSNLIQHASVGNNQYREIRIESHLGDGDDKVFLSAGSANIYAGKGHDVVYYDKTDTGYLTIDGTKATEAGNYTVTRVLGGDVKILQEVVKEQEVSVGKRTEKTQYRSYEFTHINGKNLTETDNLYSVEELIGTTRADKFFGSKFTDIFHGADGDDHIEGNDGNDRLYGDKGNDTLRGGNGDDQLYGGDGNDKLIGGTGNNYLNGGDGDDELQVQGNSLAKNVLSGGKGNDKLYGSEGADLLDGGEGNDLLKGGYGNDIYRYLSGYGHHIIDDDGGKDDKLSLADIDFRDVAFRREGNDLIMYKAEGNVLSIGHKNGITFRNWFEKESGDISNHQIEQIFDKDGRVITPDSLKKALEYQQSNNKASYVYGNDALAYGSQDNLNPLINEISKIISAAGNFDVKEERAAASLLQLSGNASDFSYGRNSITLTASA

SEQ ID NO: 104 - protein, 1024 aa, Escherichia coli
MPTITTAQIKSTLQSAKQSAANKLHSAGQSTKDALKKAAEQTRNAGNRLILLIPKDYKGQGSSLNDLVRTADELGIEVQYDEKNGTAITKQVFGTAEKLIGLTERGVTIFAPQLDKLLQKYQKAGNKLGGSAENIGDNLGKAGSVLSTFQNFLGTALSSMKIDELIKKQKSGSNVSSSELAKASIELINQLVDTAASINNNVNSFSQQLNKLGSVLSNTKHLNGVGNKLQNLPNLDNIGAGLDTVSGILSAISASFILSNADADTGTKAAAGVELTTKVLGNVGKGISQYIIAQRAAQGLSTSAAAAGLIASVVTLAISPLSFLSIADKFKRANKIEEYSQRFKKLGYDGDSLLAAFHKETGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKEYSVERSVLITQQHWDMLIGELASVTRNGDKTLSGKSYIDYYEEGKRLERRPKEFQQQIFDPLKGNIDLSDSKSSTLLKFVTPLLTPGEEIRERRQSGKYEYITELLVKGVDKWTVKGVQDKGSVYDYSNLIQHASVGNNQYREIRIESHLGDGDDKVFLSAGSANIYAGKGHDVVYYDKTDTGYLTIDGTKATEAGNYTVTRVLGGDVKVLQEVVKEQEVSVGKRTEKTQYRSYEFTHINGKNLTETDNLYSVEELIGTTRADKFFGSKFTDIFHGADGDDHIEGNDGNDRLYGDKGNDTLRGGNGDDQLYGGDGNDKLIGGTGNNYLNGGDGDDELQVQGNSLAKNVLSGGKGNDKLYGSEGADLLDGGEGNDLLKGGYGNDIYRYLSGYGHHIIDDEGGKDDKLSLADIDFRDVAFKREGNDLIMYKAEGNVLSIGHKNGITFKNWFEKESDDLSNHQIEQIFDKDGRVITPDSLKKAFEYQQSNNKVSYVYGHDASTYGSQDNLNPLINEISKIISAAGNFDVKEERSAASLLQLSGNASDFSYGRNSITLTASA

SEQ ID NO: 105 - protein, 1024 aa, Escherichia coli
MPTITTAQIKSTLQSAKQSAENKLHSAGQSTKDALKKAAEKTRNAGNRLILLIPKDYKGQGSSLNDLVRTADELGIEVQYDEKNGTAITKQVFGTAEKLIGLTERGVTIFAPKLDKLLQKYQKAGNKLGGSAENIGDNLGKAGGILSTFQNFLGTALSSMKIDELIKKQKSGGNVSSSEMAEASIELINQLVDTAASLNNNVNSFSQQLNTLGSVLSNTKHLNGVGNKLQNLPNLDNIGAGLDTVSGILSTISASFILSNADADTRTKAAAGVELTTKVLGNVGKGISQYIIAQRAAQGLSTSAAAAGLIASAVILAISPLSFLSIADKFKRANKIEEYSQRFKKLGYDGDSLLAAFHKATGAIDASLTTISTVLASVSSGISAAATTSLVGAPVSALVGAVTGIISGILEASKQAMFEHVASKMADVIAEWEKKHGKNYFENGYDARHAAFLEDNFKILSQYNKKYSVERSVLITQQHWDTLIGELAGVTRNGDKTLSGKSYIDYYEEGKRLEKKTDEFQKQVFDPLKGNIDLSDSKSSTLLKFVTPLLTPGEEIRERRQSGKYEYITELLVKGVDKWTVKGVQDKGAVYDYSNLIQHASVGNNQYRGIRIESHLGDGDDKVFLSAGSANIYAGKGHDVVYYDKTDTGYLTIDGTKATEAGNYTVTRVLGGDVKVLQEVAKEQEVSVGKRTEKTQYRSYEFTHINGKNLTETDNLYSVEELIGTTRADKFFGSKFTDIFHGADGDDLIEGNDGNDRLYGDKGNDTLSGGNGDDQLYGGDGNDKLIGGAGNNYLNGGDGDDELQVQGNSLAKNVLSGGKGNDKLYGSEGADLLDGGEGNDLLKGGYGNDIYRYLSGYGHHIIDDDGGKEDKLSLADIDFRDVAFKREGNDLIMYKAEGNVLSIGHENGITFRNWFEKESGDISNHQIEQIFDKGGRIITPDSLKKALEYQQRNNKASYVYGNDALAYGSQDNLNLLINEISKIISAAGNFDVKEERTAASLLQLSGNASDFSYGRNSITLTTSA

SEQ ID NO: 106 - DNA, 486 bp, Escherichia coli
atgttaaaaatgagtttatacgtaataatattgttattttcccttcagtttagtgcagccattactggcaaggaaagtgaggttgtttcaccattattaatggatgttaatccttcactaacaatggaaaatatttctgaattatccacatcatcggaaccatcgcaacagggggtatttcctgtaatatgtactcgacttcatcctggctccgtaatgaaacgtcagttattaaccggctgggggcctgtttttataattggtgatgatcctttttctctgcgctggatgagtgaacatctggagatccttaaatcgctaaatgcccttggtttggttgttaatgttgaatcagtagaacgaatggaggtattacagcagcgggctgatgggttattgttattgccagttatctgcgataattttgtgcaagctctgcaattaaatgcttatccggtattaatcacagagatggaaatatcacaa

SEQ ID NO: 107 - DNA, 486 bp, Escherichia coli
atgttaaaaataagtttatacgtaataatattgttattttcctttcagattagtgcagccattactagcaaggaaagtgaggttgtttcaccattattaatggatgttaattcttcactaacaatggaaaatatttctgaattatccacatcatcggaaccatcgcaacagggggtatttcctgtaatatgtactcgacttcatcctggctccgtaatgaaacgccagttattaaccggctgggggcctgtttttataattggtgatgatcctttttctctgcgctggatgagtgaacatctggagatccttaaatcgctaaatgcccttggtttggttgttaatgttgaatcagtagaacgaatggaggtattacagcagcgggctgatgggttattgttattgccagttatctgcgataatttcgtgcaaactctgcaattaaatgcttatccggtattaatcacagagatggaaatatcacaa

SEQ ID NO: 108 - DNA, 4254 bp, Escherichia coli
atgtcacattataaaacaggtcataaacaaccacgatttcgttattcagttctggcccgctgcgtggcgtgggcaaatatctctgttcaggttctttttccactcgctgtcacctttaccccagtaatggcggcacgtgcgcagcatgcggttcagccacggttgagcatgggaaatactacggtaactgctgataataacgtggagaaaaatgtcgcgtcgtttgccgcaaatgccgggacatttttaagcagtcagccagatagcgatgcgacacgtaactttattaccggaatggccacagctaaagctaaccaggaaatacaggagtggctcgggaaatatggtactgcgcgcgtcaaactgaatgtcgataaagatttctcgctgaaggattcttcgctggaaatgctttatccgatttatgatacgccaacaaatatgttgttcactcagggagcaatacatcgtaccgacgatcgtactcagtcaaatattggttttggctggcgtcatttttcaggaaatgactggatggcgggggtgaatacttttatcgatcatgatttatcccgtagtcatacccgcattggtgttggtgcggaatactggcgtgattatttgaaactgagcgccaatggttatatccgggcttctggctggaaaaaatcgccggatgttgaggattatcaggaacgcccggcgaatggttgggatatccgcgcagagggctatttacctgcctggccgcagcttggcgcaagcctgatgtatgaacagtattatggcgatgaagtcgggctgtttggtaaagataagcgccagaaagacccgcatgctatttctgccgaggtgacctatacgccagtgcctcttctgacactgagcgccgggcataagcagggcaagagtggtgagaatgacactcgctttggcctggaagttaattatcggattggcgaacctctggcgaaacaactcgatacagacagcattcgcgagcgtcgggtactggcaggcagccgctatgacctggttgagcgtaataacaacatcgttcttgagtaccgcaaatctgaagtgatccgtattgctctgcctgaacgtattgaaggcaagggcggtcagacactttctctggggcttgtggtcagcaaagcaactcacggactgaaaaatgtgcagtgggaagcgccgtcattactggctgaaggtggcaaaattaccggtcagggtagtcagtggcaagtaacgctcccggcttatcgtccaggtaaagacaattattatgcgatttctgcggttgcctacgataacaaaggcaatgcctcaaaacgcgtgcagacagaggtggtcattaccggagcaggtatgagcgccgatcgcacggcgttaacgcttgacggtcagagccgtattcaaatgcttgctaacggtaatgagcaaaaaccgctggtgctgtctctgcgcgacgccgagggccagccagtcacgggtatgaaagatcagatcaagactgaactaactttcaaaccggctggaaatattgtgactcgtaccctgaaggccactaaatcacaggcaaagccaacactgggtgagttcaccgaaactgaagccggggtgtatcagtctgtctttactaccggaacgcagtcaggtgaggcaacgattactgttagcgttgatggcatgagcaaaaccgtcactgcagaactgcgggccacgatgatggatgtggcaaactccaccctgagcgctaacgagccgtcaggtgacgtggttgctgatggtcagcaagcctatacgttgacgttgactgcggtggactccgagggtaatccggtgacgggagaagccagccgcttgcgatttgttccgcaagacactaatggtgtaaccgttggtgccatttcggaaataaaaccaggcgtttacagcgccacggtttcttcgacccgtgccggaaacgttgttgtgcgtgctttcagcgagcagtatcagctgggcacattacaacaaacgctgaagtttgttgccgggccgcttgatgcagcacattcgtccatcacactgaatcctgataaaccggtggttggcggtacagttacggcaatctggacggcaaaagatgctaatgacaaccctgtaactggtctcaatccggatgcaccgtcattatcgggcgcagctgctgtaggttctacggcatcaggctggacggataatggcgacgggacctggactgcgcagatttctctcggcactacggcgggtgaattagaagttatgccgaagctaaatggacaggatgcggcagcaaatgcggcaaaagtaaccgtggtggctgatgcgttatcttcaaaccagtcgaaagtctctgtcgcagaagatcacgtaaaagccggcgaaagtacaaccgtgacgctggtggcgaaagatgcgcatggcaacgctatcagtggtctttcgttgtcggcaagtttgacggggaccgcctctgaaggggcgaccgtttccagttggaccgaaaaaggtgacggttcctatgttgctacgttaactacaggcggaaagacgggcgagcttcgtgtcatgccgctattcaacggccagccagcagccaccgaagccgcgcagttgacggtcatcgccggagagatgtcatcagcgaactctacgcttgttgcggacaataaggctccgaccgtcaaaacgacgacggaactcaccttcaccgtgaaggatgcgtacgggaacccggtcaccgggatgaagccagatgcaccagtgtttagcggtgccgccaacacggggagtgagcgtccttcagcaggaaactggacagagaaaggtaatggggtctacgtggcgaccttaacgctgggatctgccgcgggtcagttgtctgtgatgccgcgagtgaacggccaaaatgccgttgctcagccactggtgctgaacgttgcaggtgacgcatctaaggctgagattcgtgatatgacagtgaaggttaataaccaactggctaatggacagtctgctaaccagataaccctgaccgtcgtggacagctatggtaacccgttgcaggggcaagaagttacgctgactttaccgcagggtgtgaccagcaagacggggaatacagtaacaaccaatgcggcagggaaagtggacattgagcttatgtcaacggttgcgggggaacacagcatcacggcctcagtgaataatgctcagaagacggttacggtgaaattcaaggcggatttcagtaccggtcaggcgaccctggaggttgatggcagcacgccaaaagtggcaaacgacaatgatgcctttacgctgacggcaacggttaaggatcaatacggcaaccttctgcctggcgctgtggtcgtctttaatctgcctcggggcgtcaaaccgcttgcagacggtaatatcatggtgaacgccgacaaggagggtaaagcggaactgaaagtggtctccgtgactgccggaacgtatgagatcacggcgtcggcaggaaatgaccagccttcgaatgcgcagtctgtaacgtttgtggccgataagactacggcgaccatctccagtattgaggtgattggcaaccgtgcagtggcggatggcaaaaccaaacagacgtataaagttacggtgactgatgccaataacaacctgttgaaggatagcgacgtgacgctgactgccagctcggaaaatttagttctggatcctaaagggacggcgaaaactaatgagcaaggacaggctgttttcaccggctctaccactatcgcagcgacatatacactcacggcgaaagtggaacaggccaacggtcaggtatcgacgaaaactgctgaatctaaattcgtcgcggatgataaaaacgcggtgctcgccgcatctccagaacgtgtagattctctggtggcggacgggaagactactgcaacaatgacggttaccctgatggcgggagtcaatcccgtaggaggaagtatgtgggtcgacattgaggctccggaaggagtgacggagaaggattatcaattcctgccgtcgaaggctgaccatttctcaggtgggaaaatcacgcgtacatttagtaccagcaagccaggtgtctatacgttcacattcaacgcactgacgtatggcgggtacgaaatgacgcctgtgaaggtgacaattaacgccgttgctgcagagactgaaaatggcgaggaggagatgcca

SEQ ID NO: 109 - DNA, 4245 bp, Escherichia coli
atgtcacgttataaaacagacaataaacagccacgatttcgttattcagttctggcccgctgcgtggcgtgggcaaatatctctgttcaggttctttttccactcgcagtcacctttacgccagtaatggcagcacgtgcgcagcatgcggttcagccacggttgagcatggaaaatactacggtaactgctgataataacgtggagaaaaatgtcgcgtcgcttgccgctaatgccgggacatttttaagcagtcagccagatagcgatgcgacacgtaactttattaccggaatggccaccgctaaagctaaccaggaaattcaggagtggctcgggaaatacggtactgcgcgcgtcaaactgaatgtcgataaaaatttctcgctgaaggactcttcgctggaaatgctttatccgatttatgatacaccgacaaatatgttgttcactcagggggcaatacatcgtaccgacgatcgtactcagtcaaatattggttttggctggcgtcatttttcagaaaatgactggatggcgggggtgaatacttttatcgatcatgatttatcccgtagtcatacccgcattggtgttggtgcggaatactggcgtgattatttgaaactgagcgccaatggttatatccgggcttctggctggaaaacatcgccggatgttgaggattatcaggaacgcccggcgaatggctgggatattcgtgctgagggctatttacctgcctggccgcagcttggcgcaagcctgatgtatgaacagtattatggcgatgaagtcgggctgtttggtaaagataaacgccagaaagatccacatgcgattaccgctgaagtgaattacacgccagtgcctcttctgaccctgagtgccgggcataagcagggcaagagtggtgagaatgacactcgctttggcctggaagttaattatcggattggcgaacctctggaaaaacaactcgatacagacagcattcgcgagcgtcgaatgctggcaggcagccgctatgacctggttgagcgtaataacaatatcgttcttgagtatcgcaaatctgaagtgatccgtattgctctgcctgagcgtattgaaggcaagggcggccagacggtttccctggggcttgtggtcagcaaagcaactcacggtctgaaaaatgtgcaatgggaagcgccgtctttgctggccgcaggcggaaaaattacggggcagggcaatcagtggcaagtgacgctcccggcttatcaggcaggcaaagacaattattatgcgatttcagcgattgcctacgataacaaaggcaatgcctcgaaacgtgtgcagacagaagtggttattagcggagctggtatgagcgccgatcgtacggcgttaacgcttgacggtcagagccgtattcaaatgcttgctaacggtaatgagcaaaagccgttggtgctgtctctgcgcgacgccgaggggcagccagtcacgggcatgaaagatcagatcaagactgaactaaccttcaaaccggctggaaatattgtgactcgttccctgaaggtcactaaatcacaggcaaagccaacactgggtgagttcaccgaaactgaagcaggggtgtatcagtctgtctttactaccggaacgcagtcaggtgaggcaacgattactgttagcgttgatggcatgagcaaaaccgtcactgcagaactgcgggccacgatgatggatgtggcaaactccaccctgagcgctaacgagccgtcaggtgacgtggttgctgatggtcagcaagcctacacgctgacgctgactgcggtggactccgagggtaatccggtgacgggagaagccagccgcctgcgacttgttccgcaagacactaatggtgttaccgttggtgccatttcggaaataaaacctggggtttacagcgccacggtttcttcgacccgtgccggaaacgttgttgtgcgtgccttcagcgagcagtatcagctgggcacattacaacaaacgctgaagtttgttgccgggccgcttgatgcagcacattcgtccatcaccctgaatcctgataaaccggtggttggcggtacagttacggcaatctggacggcaaaagatgctaatgacaaccctgtaactggcctcaatccggatgcaccgtcattatcgggcgcagctgctgctggttctacggcatcaggctggacggataatggcgacgggacctggactgcgcagatttctctcggcactacggcgggtgaattagacgttatgccgaagctcaatgggcaggacgcggcagcaaatgcggcaaaagtaaccgtggtggctgatgcattatcttcaaaccagtcgaaagtctctgtcgcagaagatcacgtaaaagccggtgaaagcacaaccgtaacgctggtggcgaaagatgcgcatggcaacgctatcagtggtctttcgttgtcggcaagtttgacggggaccgcctctgaaggggcgaccgtttccagttggaccgaaaaaggtgacggttcctatgttgctacgttaactacaggcggaaagacgggcgagcttcgtgtcatgccgctcttcaacggccagcctgcagccaccgaagccgcgcagctgactgttattgccggagagatgtcatcagcgaactctacgcttgttgcggacaataaaactccaacggttaaaacgacgacggaactcaccttcaccgtgaaggatgcgtacgggaatccggtcaccgggctgaagccagatgcaccagtgtttagtggtgccgccagcacggggagtgagcgtccttcagcaggaaactggacagagaaaggtaatggggtctacgtgtcgaccttaacgctgggatctgccgcgggtcagttgtctgtgatgccgcgagtgaacggccaaaatgccgttgctcagccactggtgctgaatgttgcaggtgacgcatctaaggctgagattcgtgatatgacagtgaaggttaataaccaactggctaatggacagtctgctaaccagataaccctgaccgtcgtggacagctatggtaacccgttgcaggggcaagaagttacgctgactttaccgcagggtgtgaccagcaagacggggaatacagtaacaaccaatgcggcagggaaagtggacattgagcttatgtcaacggttgcgggagaacacaatatttccgcttcggtgaatggtgctcagaagacggtcacggtgaaattcaacgcggatgccagcaccggtcaggcaaacctgcaggtagacaccgccgttcaaaaagtggcaaacggcaaagatgcctttacgctgacggcaacggttaaggatcaatacggcaaccttcttcctggcgctgtggtcgtctttaatctgcctcggggcgtcaaaccgcttgcagacggtaatatcatggtgaacgccgacaaggagggtaaagcggaactgaaagtggtttccgtgactgccggaacctatgagatcacggcgtcagcaggaaatgaccagccttcgaatgcgcagtctgtaacgtttgtggccgataagactacggcgaccatctccagtattgaggtgattggcaaccgtgcagtggcggacggcaaaaccaaacagacgtataaagttacggtgactgatgccaataacaacctgctgaaagatagcgaagtgacgctgactgccagcccggaaaatttagttctgactcccaatgggacggcgacaacgaatgagcaagggcaggctattttcaccgccacgaccactgtcgcagcgacatatacactcacggcgaaagtggaacaggccgacggtcaggaatcgacgaaaactgccgaatctaaattcgtcgcggatgataaaaacgcggagctcgccgcaacatctgatgtgcattctctggtggcggatggggtaacgacagcaacactgacggtaaccctgttctcggcaaacaacccggtaggaggaaccatgtgggtcgacattgaggctccggaaggggtgacagaggcggattatcagttcctgccgtcgaaaaatgaccatttcgcgagcgggaaaatcacgcgtacatttagtaccaacaagccaggtacatacacattcacattcaactctttgacatatggagggtatgaaatgaaaccagtgactgtgacaattaacgccgttcctgcagatactgaaggcgctgaggagaaa

SEQ ID NO: 110 - DNA, 4254 bp, Escherichia coli
atgtcacattataaaacaggtcataaacaaccacgatttcgttattcagttctggcccgctgcgtggcgtgggcaaatatctctgttcaggttctttttccactcgctgtcacctttaccccagtaatggcggcacgtgcgcagcatgcggttcagccacggttgagcatgggaaatactacggtaactgctgataataacgtggagaaaaatgtcgcgtcgtttgccgcaaatgccgggacatttttaagcagtcagccagatagcgatgcgacacgtaactttattaccggaatggccacagctaaagctaaccaggaaatacaggagtggctcgggaaatatggtactgcgcgcgtcaaactgaatgtcgataaagatttctcgctgaaggattcttcgctggaaatgctttatccgatttatgatacgccaacaaatatgttgttcactcagggagcaatacatcgtaccgacgatcgtactcagtcaaatattggttttggctggcgtcatttttcaggaaatgactggatggcgggggtgaacacctttatcgaccatgatttatcccgtagtcatacccgcattggtgttggtgcggaatactggcgcgattatctgaaactgagcgccaatggttatatccgggcttctggctggaaaaaatcgccggatgttgaggattatcaggaacgcccggcgaatggctgggatattcgtgctgagggctatttacccgcctggccgcagcttggcgcaagcctgatgtatgaacagtattatggcgatgaagtcgggctgtttggtaaagataagcgccagaaagacccgcatgctatttctgccgaggtgacctatacgccagtgcctcttctgacactgagcgccgggcataagcagggcaagagtggtgagaatgacactcgctttggcctggaagttaattatcggattggcgaacctctggcgaaacaactcgatacagacagcattcgcgagcgtcgggtactggcaggcagccgctatgacctggttgagcgtaataacaacatcgttcttgagtaccgcaaatctgaagtgatccgtattgctctgcctgaacgtattgaaggtaagggtggtcagacactttccctggggcttgtggtcagcaaagcaactcacggactgaaaaatgtgcagtgggaagcgccgtcattactggctgagggtggcaaaattaccggtcagggtagtcagtggcaagtaacgctcccggcttatcgtccaggcaaagacaattattatgcgatttctgcggttgcctacgataacaaaggcaatgcctcaaaacgcgtgcagacagaggtggtcattaccggagcaggtatgagcgccgatcgcacggcgttaacgcttgacggtcagagccgtattcaaatgcttgctaacggtaatgagcaaagaccgctggtgctgtctctgcgcgacgccgaggggcagccagtcacgggcatgaaagatcagatcaagactgaactagccttcaaaccggctggaaatattgtgactcgttccctgaaggccactaaatcacaggcaaagccaacactgggtgagttcaccgaaactgaagcaggggtgtatcagtctgtctttactaccggaacgcagtcaggtgaggcaacgattactgttagcgttgatggcatgagcaaaaccgtcactgcagaactgcgggccacgatgatggatgtggcaaactccaccctgagcgctaacgagccgtcaggtgatgtggttgctgatggtcagcaagcctatacgttgacgttgactgcggtggactccgagggtaatccggtgacgggagaagccagccgcttgcgatttgttccgcaagacactaatggtgtaaccgttggtgccatttcggaaataaaaccaggcgtttacagcgccacggtttcttcgacccgtgccggaaacgttgttgtgcgtgctttcagcgagcagtatcagctgggcacattacaacaaacgctgaagtttgttgccggtccgcttgatgcagcacattcgtccatcaccctgaatcctgataaaccggtggttggcggtacagttacggcaatctggacggcaaaagatgcctatgacaaccctgtgaccagcctcacgccggaagcgccgtcattagcgggtgccgctgctgtaggttctacggcatctggctggacaaataatggtgatgggacgtggactgcgcagattactctcggctctacggcgggtgaattagaagttatgccgaagctaaatggacaggatgcggcagcaaatgcggcaaaagtaaccgtggtggctgatgcgttatcttcaaaccagtcgaaagtctctgtcgcagaagatcacgtaaaagccggcgaaagcacaaccgtgacgcttattgcaaaagatgcacatggcaacactatcagtggtctttcgttgtcggcaagtttgacggggaccgcctctgaaggggcgaccgtttccagttggaccgaaaaaggtgacggttcctatgttgctacgttaactacaggcggaaagacgggcgagcttcgtgtcatgccgctcttcaacggccagccagcagccaccgaagccgcgcagttgacggtcatcgccggagagatgtcatcagcgaactctacgcttgttgcggccaataaggctccgaccgtcaaaatgacgacggaactcaccttcaccgtgaaggatgcgtacgggaacccggtcaccgggctgaagccagatgcaccagtgtttagcggtgccgccagcacggggagtgagcgtccttcagcaggaaactggacagagaaaggtaatggggtctacgtggcgaccttaacgctgggatctgccgcgggtcagttgtctgtgatgccgcgagtgaacggccaaaatgccgttgctcagccactggtgctgaacgttgcaggtgacgcatctaaggctgagattcgtgatatgacagtgaaggttaataaccaactggctaatggacagtctgctaaccagataaccctgaccgtcgtggacagctatggtaacccgttgcaggggcaagaagttacgctgactttaccgcagggtgtgaccagcaagacggggaatacagtaacaaccaatgcggcagggaaagtggacattgagcttatgtcaacggttgcgggggaacacagcatcacggcctcagtgaataatgctcagaagacggttacggtgaaattcaaggcggatttcagtaccggtcaggcgaccctggaggttgatggcagcacgccaaaagtggcaaacgacaatgatgcctttacgctgacggcaacggttaaggatcaatacggcaaccttctgcctggcgctgtggtcgtctttaatctgccttggggcgtcaaaccgcttgcagacggtaatatcatggtgaacgccgacaaggagggtaaagcggaactgaaagtggtctccgtgactgccggaacgtatgagatcacggtgtcggcaggaaatgaccagccttcgaatgcgcagtctgtaacgtttgtggccgataagactacggcgaccatctccagtattgaggtgattggcaaccgtgcagtggcggatggcaaaaccaaacagacgtataaagttacggtgactgatgccaataacaacctgttgaaggatagcgacgtgacgctgactgccagctcggaaaatttagttctggatcctaaagggacggcgaaaactaatgagcaaggacaggctgttttcaccggctctaccactatcgcagcgacatatacactcacggcgaaagtggaacaggccaacggtcaggtatcgacgaaaactgctgaatctaaattcgtcgcggatgataaaaacgcggtgctcgccgcatctccagaacgtgtagattctctggtggcggacgggaagactactgcaacaatgacggttaccctgatggcgggagtcaatcccgtaggaggaagtatgtgggtcgacattgaggctccggaaggagtgacggagaaggattatcaattcctgccgtcgaaggctgaccatttctcaggtgggaaaatcacgcgtacatttagtaccagcaagccaggtgtctatacgttcacattcaacgcactgacgtatggcgggtacgaaatgacgcctgtgaaggtgacaattaacgccgttgctgcagagactgaaaatggcgaggaggagatgcca

SEQ ID NO: 111 - DNA, 4251 bp, Escherichia coli
atgtcacgttataaaacaggtcataaacaaccactatttcgttattcagttctggcccgctgcgtggcgtgggcaaatatctctgttcaggttctttttccactcgctgtcacctttaccccagtaatggcggcacatgcgcagcatgcggttcagccacggttgagcatggaaaataccacggtaactgctgataataatgtggagaaaaatgtcgcgtcgtttgccgcaaatgccgggacatttttaagcagtcagccagatagcgatgcgacacgtaattttattaccggaatggccaccgctaaagctaaccaggaaatacaggagtggctcgggaaatatggtacagcgcgcgtcaaactgaatgtcgataaagatttctcgctgaaggattcttcgctggaaatgctttatccgatttatgatacgccgacaaatatgttgttcactcagggggcaatacatcgtacagacgatcgtactcagtcaaatattggttttggctggcgtcatttttcaggaaatgactggatggcgggggtgaatacttttatcgatcatgatttatcccgtagtcatacccgcattggtgttggtgcggaatactggcgcgattatctgaaactgagcgccaatggttatattcgggcttctggctggaaaaaatcgccggatattgaggattatcaggaacgcccggcgaatggttgggatatccgcgcagagggctatttacctgcctggccgcagcttggcgcaagcctgatgtatgaacagtattatggcgatgaagtcgggctgtttggtaaagataagcgccagaaagacccgcatgctatttctgccgaggtgacctatacgccagtgcctcttctgacactgagcgccgggcataagcagggcaagagcggtgagaatgacactcgctttggcctggaagttaattatcggattggcgaacctctggagaaacaactcgatacagacagcattcgcgagcgtcgaatgctggcaggcagccgctatgacctggttgagcgtaataacaacatcgttcttgagtaccgcaaatctgaagtgatccgtattgctctgcctgagcgtattgaaggtaagggcggtcagacactttccctggggcttgtggtcagcaaagcaactcacggactgaaaaatgtgcagtgggaagcgccgtcattactggctgaaggtggcaaaattaccggtcagggtagtcagtggcaagtaacgctcccggcttatcgtccaggcaaagacaattattatgcgatttctgcggttgcctacgataacaaaggcaatgcctcaaaacgcgtgcagacagaggtggtcattaccggagcaggtatgagtgccgatcgcacggcgttaacgcttgacggtcagagccgtattcaaatgcttgctaacggtaatgagcaaagaccgctggtgctgtctctgcgcgacgccgagggccagccagtcacgggcatgaaagatcagatcaagactgaactaactttcaaaccggctggaaatattgtgactcgtaccctgaaggccactaaatcacaggcaaagccaacactgggtgagttcaccgaaactgaagcaggggtgtatcagtctgtctttactaccggaacgcagtcaggtgaggcaacgattactgttagtgttgatggcatgagcaaaaccgtcactgcagaactgcgggccacgatgatggatgtggcaaactccaccctgagcgctaacgagccgtcaggtgacgtggttgctgatggtcagcaagcctacacgctgacgctgactgcggtggatactgatggtaacccggtgacgggagaggccagccgcttgcgatttgttccgcaagacactaatggtgtcaccattggtacaatttcggagataaaaccaggcgtttacagcgctacggtttcttcgacccgtgccggaaacgttgttgtgcgtgctttcagcgagcagtatcagctgggcacattacaacaaacgctgaagtttgttgccgggccgcttgatgcagcacattcgtccatcaccctgaatcctgataaaccggtggttgggggtacagttacggcaatctggacggtaaaagatgcctatgacaaccctgtgaccagcctcacgccggaagcgccgtcattagcgggtgccgctgctgtaggttctacggcatcgggctggacaaataatggtgatgggacgtggactgcgcagattactctcggctctacggcgggtgaattagaagttatgccgaagctaaatggacaggatgcggcagcaaatgcggcaaaagtaaccgtggtggctgatgcgttatcttcaaaccagtcgaaagtctctgtcgcagaagatcacgtaaaagccggcgaaagtacaaccgtgacgcttattgcaaaagatgcacatggcaacgctatcagtggtctttcgttgtcggcaagtttgacggggaccgcctctgaaggggcgaccgtttccagttggaccgaaaaaggtgacggttcctatgttgctacgttaactacaggcggaaagacgggcgagcttcgtgtcatgccgctattcaacggccagccagcagccaccgaagccgcgcagttgacggtcatcgccggagagatgtcatcagcgaactctacgcttgttgcggacaataaggctccgaccgtcaaaacgacgacggaactcaccttcaccgtgaaggatgcgtacgggaacccggtcaccgggatgaagccagatgcaccagtgtttagcggtgccgccagcacggggacagagcgaccttcaacaggagactggacagaaacaagtaatggggtctacgtggcgaccttgactctgggatctgccgcgggccagttgtctgtgatgccgcgagtgaacggccaaaatgccgttgctcagccactggtgctgaatgttgctggtgacgcatctaaggctgagattcgtgatatgacggtgaaggttgataaccagctggctaatggacaatcgactaaccaggtaaccctgaccgttgtggacacctatggtaacccgttgcagggacaaaatgtgacgctgactctgccgaaaggtgtgaccagcaagacggggaatacggtaacaaccgatgcggcaggtaaagccgacattgagctgatgtcaacggttgccggggaacacagcatcacggcctcagtgaataatgctcagaagacggttacggtgaaattcaaggcggatttcagtaccggtcaggcgagtctggaggttgatagcgccgcgccaaaagtggcaaacggcaaagatgcctttacgctgacggcgaccgttgaggataaaaatggtaaccctgttccagggagcctggtgacctttaatctgccccggggtgtcaagccgcttacaggcgataatgtctgggtgaaagccaacggtgaggggaaagcagagttgcaggtggtttcagtgactgccggaacgtatgagatcacggcatcggcggggaatagccagccttcggatacgcagactataacgtttgtagccgataaggctaccgcaaccgtctccggtattgaggtgatgggcaactatgcgctggcggacggcaaagccaaacaaacgtataaagttacggtgactgatgccaataacaatttggtgaaagatagcgaagtgacgctgactgccagcccggcttcgttaaacctggaaccgaatggcactgcgacaacgaatgagcaagggcaggctattttcaccgctaccactactgttgcggcgacatacacactcaaggcgcaagtgagtcagaccaacggtcaggtatcaacgaaaactgccgaatctaaattcgttgcggatgataaaaacgcggtactcaccgcatcatctgatatgcaatctctggtggcggatgggaaatcgactgcgaagctggaggtgacactgatgtcggcaaacaaccccgttggcgggaatatgtgggtcgacattcagacgccggaaggggtgacggaaaaggattatcagttcctgccgtcgaaaaatgaccatttcgtgagcggaaaaatcacgcgtaaatttagtaccagcaagcctggtgtctatacgttcacatttaacgccctgacctatggcgggtacgaaatgaagccagtgacggtgaccattaccgcggtggatgccgatacggcaaaggacgaggaggcgatgaaa

SEQ ID NO: 112 - DNA, 4251 bp, Escherichia coli
atgtcgcgttataaaacaggtcataaacaaccacgatttcgttattcagttctggcccgctgcgtggcgtgggcaaatatctctgttcaggttctttttccactcgctgtcacctttaccccagtaatggcggcacgtgcgcagcatgcggttcagccacggttgagcatgggaaatactacggtaactgctgataataacgtggagaaaaatgtcgcgtcgtttgccgcaaatgccgggacatttttaagcagtcagccagatagcgatgcgacacgtaactttattaccggaatggccacagctaaagctaaccaggaaatacaggagtggctcgggaaatatggtactgcgcgcgtcaaactgaatgtcgataaagatttctcgctgaaggattcttcgctggaaatgctttatccgatttatgatacgccaacaaatatgttgttcactcagggagcaatacatcgtaccgacgatcgtactcagtcaaatattggttttggctggcgtcatttttcaggaaatgactggatggcgggggtgaacacctttatcgaccatgatttatcccgtagtcatacccgcattggtgttggtgcggaatactggcgcgattatctgaaactgagcgccaatggttatattcgggcttctggctggaaaaaatcgccggatattgaggattatcaggaacgcccggcgaatggttgggatatccgcgcagagggctatttacctgcctggccgcagcttggcgcaagcctgatgtatgaacagtattatggcgatgaagtcgggctgtttggtaaagataagcgccagaaagacccgcatgctatttctgccgaggtgacctatacgccagtgcctcttctgacactgagcgccgggcataagcagggcaagagcggtgagaatgacactcgctttggcctggaagttaattatcggattggcgaacctctggagaaacaactcgatacagacagcattcgcgagcgtcgaatgctggcaggcagccgctatgacctggttgagcgtaataacaacatcgttcttgagtaccgcaaatctgaagtgatccgtattgctctgcctgagcgtattgaaggtaagggcggtcagacactttccctggggcttgtggtcagcaaagcaactcacggactgaaaaatgtgcagtgggaagcgccgtcattactggctgaaggtggcaaaattaccggtcagggtagtcagtggcaagtaacgctcccggcttatcgtccaggcaaagacaattattatgcgatttctgcggttgcctacgataacaaaggcaatgcctcaaaacgcgtgcagacagaggtggtcattaccggagcaggtatgagtgccgatcgcacggcgttaacgcttgacggtcagagccgtattcaaatgcttgctaacggtaatgagcaaagaccgctggtgctgtctctgcgcgatgccgagggccagccagtcacgggcatgaaagatcagatcaagactgaactaactttcaaaccggctggaaatattgtgactcgtaccctgaaggccactaaatcacaggcaaagccaacactgggtgagttcaccgaaactgaagccggggtgtatcagtctgtctttactaccggaacgcagtcaggtgaggcaacgattactgttagtgttgatggcatgagcaaaaccgtcactgcagaactgcgggccacgatgatggatgtggcaaactccaccctgagcgctaacgagccgtcaggtgacgtggttgctgatggtcagcaagcctacacgctgacgctgactgcggtggatactgatggtaacccggtgacgggagaggccagccgcttgcgatttgttccgcaagacactaatggtgtcaccattggtacaatttcggagataaaaccaggcgtttacagcgctacggtttcttcgacccgtgccggaaacgttgttgtgcgtgctttcagcgagcagtatcagctgggcacattacaacaaacgctgaagtttgttgccgggccgcttgatgcagcacattcgtccatcaccctgaatcctgataaaccggtggttgggggtacagttacggcaatctggacggtaaaagatgcctatgacaaccctgtgaccagcctcacgccggaagcgccgtcattagcgggtgccgctgctgtaggttctacggcatcgggctggacaaataatggtgatgggacgtggactgcgcagattactctcggctctacggcgggtgaattagaagttatgccgaagctaaatggacaggatgcggcagcaaatgcggcaaaagtaaccgtggtggctgatgcgttatcttcaaaccagtcgaaagtctctgtcgcagaagatcacgtaaaagccggcgaaagtacaaccgtgacgcttattgcaaaagatgcacatggcaacgctatcagtggtctttcgttgtcggcaagtttgacggggaccgcctctgaaggggcgaccgtttccagttggaccgaaaaaggtgacggttcctatgttgctacgttaactacaggcggaaagacgggcgagcttcgtgtcatgccgctattcaacggccagccagcagccaccgaagccgcgcagttgacggtcatcgccggagagatgtcatcagcgaactctacgcttgttgcggacaataaggctccgaccgtcaaaacgacgacggaactcaccttcaccgtgaaggatgcgtacgggaacccggtcaccgggatgaagccagatgcaccagtgtttagcggtgccgccagcacggggacagagcgaccttcaacaggagactggacagaaacaagtaatggggtctacgtggcgaccttgactctgggatctgccgcgggccagttgtctgtgatgccgcgagtgaacggccaaaatgccgttgctcagccactggtgctgaatgttgctggtgacgcatctaaggctgagattcgtgatatgacggtgaaggttgataaccagctggctaatggacaatcgactaaccaggtaaccctgaccgttgtggacacctatggtaacccgttgcagggacaaaatgtgacgctgactctgccgaaaggtgtgaccagcaagacggggaatacggtaacaaccgatgcggcaggtaaagccgacattgagctgatgtcaacggttgccggggaacacagcatcacggcctcagtgaataatgctcagaagacggttacggtgaaattcaaggcggatttcagtaccggtcaggcgagtctggaggttgatagcgccgcgccaaaagtggcaaacggcaaagatgcctttacgctgacggcgaccgttgaggataaaaatggtaaccctgttccagggagcctggtgacctttaatctgccccggggtgtcaagccgcttacaggcgataatgtctgggtgaaagccaacggtgaggggaaagcagagttgcaggtggtttcagtgactgccggaacgtatgagatcacggcatcggcggggaatagccagccttcggatacgcagactataacgtttgtagccgataaggctaccgcaaccgtctccggtattgaggtgatgggcaactatgcgctggcggacggcaaagccaaacaaacgtataaagttacggtgactgatgccaataacaatttggtgaaagatagcgaagtgacgctgactgccagcccggcttcgttaaacctggaaccgaatggcactgcgacaacgaatgagcaagggcaggctattttcaccgctaccactactgttgcggcgacatacacactcaaggcgcaagtgagtcagaccaacggtcaggtatcaacgaaaactgccgaatctaaattcgttgcggatgataaaaacgcggtactcaccgcatcatctgatatgcaatctctggtggcggatgggaaatcgactgcgaagctggaggtgacactgatgtcggcaaacaaccccgttggcgggaatatgtgggtcgacattcagacgccggaaggggtgacggaaaaggattatcagttcctgtcgtcgaaaaatgaccatttcgtgagcggaaaaatcacgcgtaaatttagtaccagcaagcctggtgtctatacgttcacatttaacgccctgacctatggcgggtacgaaatgaagccagtgacggtgaccattaccgcggtggatgccgatacggcaaaggacgaggaggcgatgaaa

SEQ ID NO: 113 - DNA, 4248 bp, Escherichia coli
atgtcacgttataaaacagacaataaacagccacgatttcgttattcagttctggcccgctgcgtggcgtgggcaaatatctctgttcaggttctttttccactcgcagtcacctttacgccagtaatggcagcacgtgcgcagcatgcggttcagccacggttgagcatggaaaatactacggtaactgctgataataacgtggagaaaaatgtcgcgtcgcttgccgctaatgccgggacatttttaagcagtcagccagatagcgatgcgacacgtaactttattaccggaatggccaccgctaaagctaaccaggaaattcaggagtggctcgggaaatacggtactgcgcgcgtcaaactgaatgtcgataaaaaattctcgctgaaggactcttcgctggaaatgctttatccgatttatgatacaccgacaaatatgttgttcactcagggggcaatacatcgtaccgacgatcgtactcagtcaaatattggttttggctggcgtcatttttcagaaaatgactggatggcgggggtgaatacttttatcgatcatgatttatcccgtagtcatacccgcattggtgttggtgcggaatactggcgtgattatttgaaactgagcgccaatggttatatccgggcttctggctggaaaaaatcgccggatgttgaggattatcaggaacgcccggcgaatggctgggatattcgtgctgagggctatttacctgcctggccgcagcttggcgcaagcctgatgtatgaacagtattatggcgatgaagtcgggctgtttggtaaagataaacgccagaaagatccacatgcgattaccgctgaagtgaattacacgccagtgcctcttctgaccctgagtgccgggcataagcagggcaagagtggtgagaatgacactcgctttggcctggaagttaattatcggattggcgaacctctggaaaaacaactcgatacagacagcattcgcgagcgtcgaatgctggcaggcagccgctatgacctggttgagcgtaataacaatatcgttcttgagtatcgcaaatctgaagtgatccgtattgctctgcctgagcgtattgaaggcaagggcggccagacggtttccctggggcttgtggtcagcaaagcaactcacggtctgaaaaatgtgcaatgggaagcgccgtctttgctggccgcaggcggaaaaattacggggcagggcaatcagtggcaagtgacgctcccggcttatcaggcaggcaaagacaattattatgcgatttcagcgattgcctacgataacaaaggcaatgcctcgaaacgtgtgcagacagaagtggttattagcggagctggtatgagcgccgatcgtacggcgttaacgcttgacggtcagagccgtattcaaatgcttgctaacggtaatgagcaaaagccgttggtgctgtctctgcgcgacgccgaggggcagccagtcacgggcatgaaagatcagatcaagactgaactaaccttcaaaccggctggaaatattgtgactcgtaccctgaaggccactaaatcacaggcaaagccaacactgggtgagttcaccgaaactgaagcaggggtgtatcagtctgtctttactaccggaacgcagtcaggtgaggcaacgattactgttagcgttgatgacatgagcaaaactgtcactgcagaactgcgggccacgatgatggatgtggcaaactccaccctgagcgctaacgagccgtcaggtgatgtggttgctgatggtcagcaagcctacacgctgacactgacagcggtggactccgagggtaatccggtgacgggagaagccagccgcctgcgacttgttccgcaagacactaatggtgtaaccgttggtgccatttcggaaataaaaccaggggtttacagcgccacggtttcttcgacccgtgccggaaacgttgttgtgcgtgccttcagcgagcagtatcagctgggcacattacaacaaacgctgaagtttgttgccgggccgcttgatgcagcacattcgtccatcacactgaatcctgataaaccggtggttggcggtacagttacggcaatctggacggcaaaagatgctaatgacaaccctgtaactggcctcaatccggatgcaccgtcattatcgggcgcagctgctgctggttctacggcatcaggctggacggataatggcgacgggacctggactgcgcagatttctctcggcactacggcgggtgaattagacgttatgccgaagctcaatgggcaggacgcggcagcaaatgcggcaaaagtaaccgtggtggctgatgcattatcttcaaaccagtcgaaagtctctgtcgcagaagatcacgtaaaagccggtgaaagcacaaccgtaacgctggtggcgaaagatgcgcatggcaacgctatcagtggtctttcgttgtcggcaagtttgacggggaccgcctctgaaggggcgaccgtttccagttggaccgaaaaaggtgacggttcctatgttgctacgttaactacaggcggaaagacgggcgagcttcgtgtcatgccgctcttcaacggccagcctgcagccaccgaagccgcgcagctgactgttattgccggagagatgtcatcagcgaactctacgcttgttgcggacaataaaactccaacggttaaaacgacgacggaactcaccttcaccgtgaaggatgcgtacgggaatccggtcaccgggctgaagccagatgcaccagtgtttagtggtgccgccagcacggggagtgagcgtccttcagcaggaaactggacagagaaaggtaatggggtctacgtgtcgaccttaacgctgggatctgccgcgggtcagttgtctgtgatgccgcgagtgaacggccaaaatgccgttgctcagccactggtgctgaatgttgcaggtgacgcatctaaggctgagattcgtgatatgacagtgaaggttaataaccaactggctaatggacagtctgctaaccagataaccctgaccgtcgtggacagctatggtaacccgttgcaggggcaagaagttacgctgactttaccgcagggtgtgaccagcaagacggggaatacagtaacaaccaatgcggcagggaaagtggacattgagcttatgtcaacggttgcaggggaacttgagatcgaggcctcggtgaaaaactctcagaagacggtcaaggtgaaattcaaggcggatttcagtaccggtcaggcgagcctggaggtagacgccgctgctcaaaaagtggcaaacggcaaagatgcctttacgctgacggcaacggttaaggatcaatacggcaaccttcttcctggcgctgtggtcgtctttaatctgcctcggggcgtcaaaccgcttgcagacggtaatatcatggtgaacgccgacaaggagggtaaagcggaactgaaagtggtttccgtgactgccggaacctatgagatcacggcgtcagcaggaaatgaccagccttcgaatgcgcagtctgtaacgtttgtggctgataagactacggcgaccatctccagtattgaggtgattggcaaccgtgcagtggcggacggcaaaaccaaacagacgtataaagttacggtgactgatgccaataacaacctgctgaaagatagcgaagtgacgctgactgccagcccggaaaatttagttctgactcccaatgggacggcgacaacgaatgagcaagggcaggctattttcaccgccacgaccactgtcgcagcgacatatacactcacggcgaaagtggaacaggccgacggtcaggaatcgacgaaaactgccgaatctaaattcgtcgcggatgataaaaacgcggtgctcgctgcatctccagagcgtgtagattctctggtggcggacgggaagactactgcaacactgacggttactctgatgtcgggtgtcaaccccgtaggaggaaccatgtgggtcgacattgaggctccggaaggggtgacagaggcggattatcagttcctgccgtcgaaaaatgaccatttcgcgagcgggaaaatcacgcgtacatttagtaccaacaagccaggtacatacacattcacattcaactctttgacatatggagggtatgaaatgaaaccagtgactgtgacaattaacgccgttcctgcagatactgaaggcgctgaggagaaa

SEQ ID NO: 114 - DNA, 4251 bp, Escherichia coli
atgtcgcgttataaaacaggtcataaacaaccacgatttcgttattcagttctggcccgctgcgtggcgtgggcaaatatctctgttcaggttctttttccactcgctgtcacctttaccccagtaatggcggcacgtgcgcagcatgcggttcagccacggttgagcatgggaaatactacggtaactgctgataataacgtggagaaaaatgtcgcgtcgtttgccgcaaatgccgggacatttttaagcagtcagccagatagcgatgcgacacgtaactttattaccggaatggccacagctaaagctaaccaggaaatacaggagtggctcgggaaatatggtactgcgcgcgtcaaactgaatgtcgataaagatttctcgctgaaggattcttcgctggaaatgctttatccgatttatgatacgccaacaaatatgttgttcactcagggagcaatacatcgtaccgacgatcgtactcagtcaaatattggttttggctggcgtcatttttcaggaaatgactggatggcgggggtgaacacctttatcgaccatgatttatcccgtagtcatacccgcattggtgttggtgcggaatactggcgcgattatctgaaactgagcgccaatggttatattcgggcttctggctggaaaaaatcgccggatattgaggattatcaggaacgcccggcgaatggttgggatatccgcgcagagggctatttacctgcctggccgcagcttggcgcaagcctgatgtatgaacagtattatggcgatgaagtcgggctgtttggtaaagataagcgccagaaagacccgcatgctatttctgccgaggtgacctatacgccagtgcctcttctgacactgagcgccgggcataagcagggcaagagcggtgagaatgacactcgctttggcctggaagttaactaccgaattggcgaacctttggcgaaacaactcgatacggatagcattcgcgagcgtcgggtactggcaggcagccgctatgacctggttgagcgtaataacaacatcgttcttgagtaccgcaaatctgaagtgatccgtattgctctgcctgagcgtattgaaggtaagggcggtcagacactttccctggggcttgtggtcagcaaagcaactcacggactgaaaaatgtgcagtgggaagcgccgtcattactggctgaaggtggcaaaattaccggtcagggtagtcagtggcaagtaacgctcccggcttatcgtccaggcaaagacaattattatgcgatttctgcggttgccaacgataacaaaggcaatgcctcaaaacgcgtgcagacagaggtggtcattaccggagcaggtatgagtgccgatcgcacggcgttaacgcttgacggtcagagccgtattcaaatgcttgctaacggtaatgagcaaagaccgctggtgctgtctctgcgcgacgccgagggccagccagtcacgggcatgaaagatcagatcaagactgaactaactttcaaaccggctggaaatattgtgactcgtaccctgaaggccactaaatcacaggcaaagccaacactgggtgagttcaccgaaactgaagcaggggtgtatcagtctgtctttactactggaacgcagtcaggtgaggcaacgattactgttagtgttgatggcatgagcaaaaccgtcactgcagaactgcgggccacgatgatggatgtggcaaactccaccctgagcgctaacgagccgtcaggtgacgtggttgctgatggtcagcaagcctatacgttgacgttgactgcggtggactccgagggtaatccggtgacgggagaagccagccgcttgcgatttgttccgcaagacactaatggtgtaaccgttggtgccatttcggaaataaaaccaggcgtttacagcgccacggtttcttcgacccgtgccggaaacgttgttgtgcgtgctttcagcgagcagtatcagctgggcacattacaacaaacgctgaagtttgttgccgggccgcttgatgcagcacattcgtccatcacactgaatcctgataaaccggtggttggcggtacagttacggcaatctggacggcaaaagatgctaatgacaaccctgtaactggtctcaatccggatgcaccgtcattatcgggcgcagctgctgctggttctacggcatcaggctggacggataatggcgacgggacctggactgcgcagatttctctcggcactacggcgggtgaattagaggttattccgaagctaaatggacaggatgcggcagcaaatgcggcaaaagtaaccgtggtggctgatgcgttatcttcaaaccagtcgaaagtctctgtcgcagaagatcacgtaaaagccggcgaaagtacaaccgtgacgctggtggcgaaagatgcgcatggcaacgctatcagtggtctttcgttgtcggcaagtttgacggggaccgcctctgaaggggcgaccgtttccagttggaccgaaaaaggtgacggttcctatgttgctacgttaactacaggcggaaagacgggcgagcttcgtgtcatgccgctattcaacggccagccagcagccaccgaagccgcgcagttgactgtcattgcgggggagatgtcatcagcgaactctacgcttgttgctgacaatgaggctccgaccgtcaaaacgacgacgaaactcaccttcaccgtgaaggatgcgtacgggaaccttgtcaccgggctgaagccagatgcaccgcagtttagtggtgccgccagcacggggacagagcgaccttcaacaggagactggacagaaacaagtaatggggtctacgtggcgaccttgactctgggatctgccgcgggccagttgtctgtgatgccgcgagtgaacggccaaaatgccgttgctcagccactggtgctgaatgttgctggtgacgcatctaaggctgagattcgtgatatgacggtgaaggttgataaccagctggctaatggacaatcgactaaccaggtaaccctgaccgttgtggacacctatggtaacccgttgcagggacaaaatgtgacgctgactctgccgaaaggtgtgaccagcaagacggggaatacggtaacaaccgatgcggcaggtaaagccgacattgagctgatgtcaacggttgccggggaacacagcatcacggcctcagtgaataatgctcagaagacggttacggtgaaattcaaggcggatttcagtaccggtcaggcgagtctggaggttgatagcgccgcgccaaaagtggcaaacggcaaagatgcctttacgctgacggcgaccgttgaggataaaaatggtaaccctgttccagggagcctggtgacctttaatctgccccggggtgtcaagccgcttacaggcgataatgtctgggtgaaagccaacggtgaggggaaagcagagttgcaggtggtttcagtgactgccggaacgtatgagatcacggcatcggcggggaatagccagccttcggatacgcagactataacgtttgtagccgataaggctaccgcaaccgtctccggtattgaggtgatgggcaactatgcgctggcggacggtaaagccaaacaaacgtataaagttacggtgactgatgccaataacaatttggtgaaagatagcgaagtgacgctgactgccagcccggcttcgttaaacctggaaccgaatggcactgcgacaacgaatgagcaagggcaggctattttcaccgctaccactactgttgcggcgacatacacactcaaggcgcaagtgagtcagaccaacggtcaggtatcaacgaaaactgccgaatctaaattcgttgcggatgataaaaacgcggtactcaccgcatcatctgatatgcaatctctggtggcggatgggaaatcgactgcgaagctggaggtgacactgatgtcggcaaacaaccccgttggcgggaatatgtgggtcgacattcagacgccggaaggggtgacggagaaggattatcagttcctgccgtcgaaaaatgaccatttcgtgagcggaaaaatcacgcgtaaatttagtaccagcaagcctggtgtctatacgttcacatttaacgccctgacctatggcgggtacgaaatgaagccagtgacggtgaccattaccgcggtggatgccgatacggcaaaggacgaggaggcgatgaaa

SEQ ID NO: 115 - DNA, 4248 bp, Escherichia coli
atgtcacgttataaaacaggtcataaacaaccacgatttcgttattcagttctggcccgctgcgtggcgtggacaaatatctctgttcaggttctttttccactcgctgtcacctttaccccagtaatggcggcacgtgcgcagcatgcggttcagccacggttgagcatgggaaatactacggtaactgctgataataacgtggagaaaaatgtcgcgtcgtttgccgcaaatgccgggacatttttaagcagtcagccagatagcgatgcgacacgtaattttattaccggaatggccaccgctaaagctaaccaggaaattcaggagtggctcgggaaatatggtacagcgcgcgtcaaactgaatgtcgataaagatttctcgctgaaggactcttcgctggaaatgctttatccgatttatgatacaccgacaaatatgttgttcactcagggggcaatacatcgtaccgacgatcgtactcagtcaaatattggttttggctggcgtcatttttcagaaaatgactggatggcgggggtgaatacttttatcgatcatgatttatcccgtagtcatacccgcattggtgttggtgcggaatactggcgtgattatttgaaactgagcgccaatggttatatccgggcttctggctggaaaaaatcgccggatgttgaggattatcaggaacgcccggcgaatggctgggatattcgtgctgagggctatttacctgcctggccgcagcttggcgcaagcctgatgtatgaacagtattatggcgatgaagtcgggctgtttggtaaagataaacgccagaaagatccacatgcgattaccgctgaagtgaattacacgccagtgcctcttctgaccctgagtgccgggcataagcagggcaagagtggtgagaatgacactcgctttggcctggaagttaattatcggattggcgaacctctggaaaaacaactcgatacagacagcattcgcgagcgtcgaatgttggcaggcagccgctatgacctggttgagcgtaataacaatatcgttcttgagtatcgcaaatctgaagtgatccgtattgctctgcctgagcgtattgaaggcaagggcggccagacggtttccctggggcttgtggtcagcaaagcaactcacggtctgaaaaatgtgcaatgggaagcgccgtctttgctggccgcaggcggaaaaattacggggcagggcaatcagtggcaagtgacgctcccggcttatcaggcaggcaaagacaattattatgcgatttcagcgattgcctacgataacaaaggcaatgcctcgaaacgtgtgcagacagaagtggttattagcggagctggtatgagcgccgatcgtacggcgttaacgcttgacggtcagagccgtattcaaatgcttgctaacggtaatgagcaaaagccgttggtgctgtctctgcgcgacgccgaggggcagccagtcacgggcatgaaagatcagatcaagactgaactaaccttcaaaccggctggaaatattgtgactcgtaccctgaaggccactaaatcacaggcaaagccaacactgggtgagttcaccgaaactgaagcaggggtgtatcagtctgtctttactaccggaacgcagtcaggtgaggcaacgattactgttagcgttgatgacatgagcaaaactgtcactgcagaactgcgggccacgatgatgaatgtggcaaactccaccctgagcgctaacgagccgtcaggtgatgtggttgctgatggtcggcaagcctacacgctgacactgacagcggtggactccgagggtaatccggtgacgggagaagccagccgcctgcgacttgttccgcaagacactaatggtgtaaccgttggtgccatttcggaaataaaaccagggggttacagcgccacggtttcttcgacccgtgccggaaacgttgttgtgcgtgtcttcagcgagcagtatcagctgggcacattacaacaaacgctgaagtttgttgccgggccgcttgatgcagcacattcgtccatcaccctgaatcctgataaaccggtggttggcggtacagttacggcaatctggacggcaaaagatgctaatgacaaccctgtaactggcctcaatccggatgcaccgtcattatcgggcgcagctgctgctggttctacggcatcaggctggacggataatggcgacgggacctggactgcgcagatttctctcggcactacggcgggtgaattagacgttatgccgaagctcaatgggcaggacgcggcagcaaatgcggcaaaagtaaccgtggtggctgatgcattatcttcaaaccagtcgaaagtctctgtcgcagaagatcacgtaaaagccggtgaaagcacaaccgtaacgctggtggcgaaagatgcgcatggcaacgctatcagtggtctttcgttgtcggcaagtttgacggggaccgcctctgaaggggcgaccgtttccagttggaccgaaaaaggtgacggttcctatgttgctacgttaactacaggcggaaagacgggcgagcttcgtgtcatgccgctcttcaacggccagcctgcagccaccgaagccgcgcagctgactgttattgccggagagatgtcatcagcgaactctacgcttgttgcggacaataaaactccaacggttaaaacgacgacggaactcaccttcaccgtgaaggatgcgtacgggaatccggtcaccgggctgaagccagatgcaccagtgtttagtggtgccgccagcacggggagtgagcgtccttcagcaggaaactggacagagaaaggtaatggggtctacgtgtcgaccttaacgctgggatctgccgcgggtcagttgtctgtgatgccgcgagtgaacggccaaaatgccgttgctcagccactggtgctgaatgttgcaggtgacgcatctaaggctgagattcgtgatatgacagtgaaggttaataaccaactggctaatggacagtctgctaaccagataaccctgaccgtcgtggacagctatggtaacccgttgcaggggcaagaagttacgctgactttaccgcagggtgtgaccagcaagacggggaatacagtaacaaccaatgcggcagggaaagtggacattgagcttatgtcaacggttgcaggggaacttgagatcgaggcctcggtgaaaaactctcagaagacggtcaaggtgaaattcaaggcggatttcagtaccggtcaggcgagcctggaggtagacgccgctgctcaaaaagtggcaaacggcaaagatgcctttacgctgacggcaacggttaaggatcaatacggcaaccttcttcctggcgctgtggtcgtctttaatctgcctcggggcgtcaaaccgcttgcagacggtaatatcatggtgaacgccgacaaggagggtaaagcggaactgaaagtgggttccgtgactgccggaacctatgagatcacggcgtcagcaggaaatgaccagccttcgaatgcgcagtctgtaacgtttgtggctgataagactacggcgaccatctccagtattgaggtgattggcaaccgtgcagtggcggacggcaaaaccaaacagacgtataaagttacggtgactgatgccaataacaacctgctgaaagatagcgaagtgacgctgactgccagcccggaaaatttagttctgactcccaatgggacggcgacaacgaatgagcaagggcaggctattttcaccgccacgaccactgtcgcagcgacatatacactcacggcgaaagtggaacaggccgacggtcaggaatcgacgaaaactgccgaatctaaattcgtcgcggatgataaaaacgcggtgctcgctgcatctccagagcgtgtagattctctggtggcggacgggaagactactgcaacactgacggttactctgatgtcgggtgtcaaccccgtaggaggaaccatgtgggtcgacattgaggctccggaaggggtgacagaggcggattatcagttcctgccgtcgaaaaatgaccatttcgcgagcgggaaaatcacgcgtacatttagtaccaacaagccaggtacatacacattcacattcaactctttgacatatggagggtatgaaatgaaaccagtgactgtgacaattaacgccgttcctgcagatactgaaggcgctgaggagaaa

SEQ ID NO: 116 - DNA, 4251 bp, Escherichia coli
atgtcacattataaaacaggtcataaacaaccacgatttcgttattcagttctggcccgctgcgtggcgtgggcaaatatctctgttcaggttctttttccactcgctgtcacctttaccccagtaatggcggcacgtgcgcagcatgcggttcagccacggttgagcatgggaaatactacggtaactgctgataataacgtggagaaaaatgtcgcgtcgtttgccgcaaatgccgggacatttttaagcagtcagccagatagcgatgcgacacgtaactttattaccggaatggccacagctaaagctaaccaggaaatacaggagtggctcgggaaatatggtactgcgcgcgtcaaactgaatgtcgataaagatttctcgctgaaggattcttcgctggaaatgctttatccgatttatgatacgccaacaaatatgttgttcactcagggagcaatacatcgtaccgacgatcgtactcagtcaaatattggttttggctggcgtcatttttcaggaaatgactggatggcgggggtgaacacctttatcgaccatgatttatcccgtagtcatacccgcattggtgttggtgcggaatactggcgcgattatctgaaactgagcgccaatggttatatccgggcttctggctggaaaaaatcgccggatgttgaggattatcaggaacgcccggcgaatggctgggatattcgtgctgagggctatttacccgcctggccgcagcttggcgcaagcctgatgtatgaacagtattatggcgatgaagtcgggctgtttggtaaagataagcgccagaaagacccgcatgctatttctgccgaggtgacctatacgccagtgcctcttctgacactgagcgccgggcataagcagggcaagagtggtgagaatgacactcgctttggcctggaagttaattatcggattggcgaacctctggcgaaacaactcgatacagacagcattcgcgagcgtcgggtactggcaggcagccgctatgacctggttgagcgtaataacaacatcgttcttgagtaccgcaaatctgaagtgatccgtattgctctgcctgaacgtattgaaggtaagggtggtcagacactttccctggggcttgtagtcagcaaagcaactcacggactgaaaaatgtgcagtgggaagcgccgtcattactggctgagggtggcaaaattaccggtcagggtagtcagtggcaagtaacgctcccggcttatcgtccaggcaaagacaattattatgcgatttctgcggttgcctacgataacaaaggcaatgcctcaaaacgcgtgcagacagaggtggtcattaccggagcaggtatgagcgccgatcgcacggcgttaacgcttgacggtcagagccgtattcaaatgcttgctaacggtaatgagcaaagaccgctggtgctgtctctgcgcgacgccgaggggcagccagtcacgggcatgaaagatcagatcaagactgaactagccttcaaaccggctggaaatattgtgactcgttccctgaaggccactaaatcacaggcaaagccaacactgggtgagttcaccgaaactgaagcaggggtgtatcagtctgtctttactaccggaacgcagtcaggtgaggcaacgattactgttagcgttgatggcatgagcaaaaccgtcactgcagaactgcgggccacgatgatggatgtggcaaactccaccctgagcgctaacgagccgtcaggtgatgtggttgctgatggtcagcaagcctatacgttgacgttgactgcggtggactccgagggtaatccggtgacgggagaagccagccgcttgcgatttgttccgcaagacactaatggtgtaaccgttggtgccatttcggaaataaaaccaggcgtttacagcgccacggtttcttcgacccgtgccggaaacgttgttgtgcgtgctttcagcgagcagtatcagctgggcacattacaacaaacgctgaagtttgttgccgggccgcttgatgcagcacattcgtccatcaccctgaatcctgataaaccggtggttgggggtacagttacggcaatctggacggtaaaagatgcctatgacaaccctgtgaccagcctcacgccggaagcgccgtcattagcgggtgccgctgctgtaggttctacggcatcgggctggacaaataatggtgatgggacgtggactgcgcagattactctcggctctacggcgggtgaattagaagttatgccgaagctaaatggacaggatgcggcagcaaatgcggcaaaagtaaccgtggtggctgatgcgttatcttcaaaccagtcgaaagtctctgtcgcagaagatcacgtaaaagccggcgaaagtacaaccgtgacgctggtggcgaaagatgcgcatggcaacgctatcagtggtctttcgttgtcggcaagtttgacggggaccgcctctgaaggggcgaccgtttccagttggaccgaaaaaggtgacggttcctatgttgctacgttaactacaggcggaaagacgggcgagcttcgtgtcatgccgctattcaacggccagccagcagccaccgaagccgcgcagttgacggtcatcgccggagagatgtcatcagcgaactctacgcttgttgcggacaataaggctccgaccgtcaaaacgacgacggaactcaccttcaccgtgaaggatgcgtacgggaacccggtcaccgggatgaagccagatgcaccagtgtttagcggtgccgccagcacggggacagagcgaccttcaacaggagactggacagaaacaagtaatggggtctacgtggcgaccttgactctgggatctgccgcgggccagttgtctgtgatgccgcgagtgaacggccaaaatgccgttgctcagccactggtgctgaatgttgctggtgacgcatctaaggctgagattcgtgatatgacggtgaaggttgataaccagctggctaatggacaatcgactaacctggtaaccctgaccgttgtggacacctatggtaatccgttgcaggggcaagaagttacgctgaatttaccgcagggtgtgaccagcaagacggggaatacagtaacaaccaatgcggcaggtaaagcggatattgagttgatatcaaccgttgcaggggaacttgaaatcgcggccgcggtgaaaaactctcagaagacggtcacggtgaaattcaacgcggatgccagcaccggtcaggcaaacctgcaggtagacaccgccgttcaaaaagtagcaaacggcaaagatgcctttacgctgacggcgaccgttgaggataaaaatggtaaccctgttccagggagcctggtgacctttaatctaccccggggtgtcaagccgcttacaggcgataatgtctgggtgaaagccaacgatgaggggaaagccgagttgcaggtggtttcagtgactgccggaacgtatgagatcacggcatcggcggggaatagccagccttcgaatacgcagactataacgtttgtagccgataaggctaccgcaaccgtctccggtattgaggtgatgggcaactatgcgctggcggacggcaaagccaaacaaacgtataaagttacggtgactgatgccaataacaatttggtgaaagatagcgaagtgacgctgactgccagcccggcttcgttaaacctggaaccgaatggcactgcgacaacgaatgagcaagggcaggctattttcaccgctaccactactgttgcggcgacatacacactcaaggcgcaagtgagtcagaccaacggtcaggtatcaacgaaaactgccgaatctaaattcgttgcggatgataaaaacgcggtactcaccgcatcatctgatatgcaatctctggtggcggatgggaaatcgactgcgaagctggaggtgacactgatgtcggcaaacaaccccgttggcgggaatatgtgggtcgacattcagacgccggaaggggtgacggagaaggattatcagttcctgccgtcgaaaaatgaccatttcgtgagcggaaaaatcacgcgtaaatttagtaccagcaagcctggtgtctatacgttcacatttaacgccctgacctatggcgggtacgaaatgaagccagtgacggtgaccattaccgcggtggatgccgatacggcaaaggacgaggaggcgatgaaa

SEQ ID NO: 117 - DNA, 4251 bp, Escherichia coli
atgtcacgttataaaacaggtcataaacaaccacgatttcgttattcagttctggcccgctgcgtggcgtgggcaaatatctctgttcaggttctttttccactcgctgtcacctttaccccagtaatggcggcacgtgcgcagcatgcggttcagccacggttgagcatgggaaatactacggtaactgctgataataacgtggagaaaaatgtcgcgtcgtttgccgcaaatgccgggacatttttaagcagtcagccagatagcgatgcgacacgtaattttattaccggaatggccaccgctaaagctaaccaggaaatacaggagtggctcgggaaatatggtacagcgcgcgtcaaactgaatgtcgataaagatttctcgctgaaggattcttcgctggaaatgctttatccgatttatgatacgccgacaaatatgttgttcactcagggggcaatacatcgtacagacgatcgtactcagtcaaatattggttttggctggcgtcatttttcaggaaatgactggatggcgggggtgaacacctttatcgaccatgatttatcccgtagtcatacccgcattggtgttggtgcggaatactggcgcgattatctgaaactgagcgccaatggttatattcgggcttctggctggaaaaaatcgccggatattgaggattatcaggaacgcccggcgaatggttgggatatccgcgcagagggctatttacctgcctggccgcagcttggcgcaagcctgatgtatgaacagtattatggcgatgaagtcgggctgtttggtaaagataagcgccagaaagacccgcatgctatttctgccgaggtgacctatacgccagtgcctcttctgacactgagcgccgggcataagcagggcaagagcggtgagaatgacactcgctttggcctggaagttaactaccgaattggcgaacctttggcgaaacaactcgatacggatagcattcgcgagcgtcgggtactggcaggcagccgctatgacctggttgagcgtaataacaacatcgttcttgagtaccgcaaatctgaagtgatccgtattgctctgcctgagcgtattgaaggtaagggcggtcagacactttccctggggcttgtggtcagcaaagcaactcacggactgaaaaatgtgcagtgggaagcgccgtcattactggctgaaggtggcaaaattaccggtcagggtagtcagtggcaagtaacgctcccggcttatcgtccaggcaaagacaattattatgcgatttcagcagttgcctacgataacaaaggcaatacctcaaaacgcgtgcagacagaggtggtcattaccggagctggtatgagcgccgatcgcacggcgttaacgcttgacggtcagagccgtattcaaatgcttgctaacggtaatgagcaaaaaccgctggtgctgtctctgcgcgacgccgagggccagccagtcacgggcatgaaagatcagatcaagactgaactaactttcaaaccggctggaaatattgtgactcgttccctgaaggccactaaatcacaggcaaagccaacactgggtgagttcaccgaaactgaagcaggggtgtatcagtctgtctttactaccggaacgcagtcaggtgaggcaacgattactgttagcgttgatggcatgagcaaaaccgtcactgcagaactgcgggccacgatgatggatgtggcaaactccaccctgagcgctaacgagccgtcaggtgacgtggttgctgatggtcagcaagcctatacgttgacgttgactgcggtggactccgagggtaatccggtgacgggagaagccagccgcttgcgatttgttccgcaagacactaatggtgtaaccgttggtgccatttcggaaataaaaccaggcgtttacagcgccgcggtttcttcgacccgtgccggaaacgttgttgtgcgtgctttcagcgagcagtatcagctgggcacattacaacaaacgctgaagtttgttgccgggccgcttgatgcagcacattcgtccatcaccctgaatcctgataaaccggtggttggggggacagttacggcaatctggacggtaaaagatgcctatgacaaccctgtgaccagcctcacgccggaagcgccgtcattagcgggtgccgctgctgaaggttctacggcatcgggctggacaaataatggtgatgggacgtggactgcgcagattactctcggctctacggcgggtgaattagaagttatgccgaagctaaatggacagaatgcggcagcaaatgcggcaaaagtaaccgtggtggctgatgcgttatcttcaaaccagtcgaaagtctctgtcgcagaagatcacgtaaaagccggcgaaagcacaaccgtgacgctggtggcgaaagatgcgcatggcaacgctatcagtggtcttgcgttgtcggcaagtttgacggggaccgcctctgaaggggcgaccgtttccagttggaccgaaaaaggtaacggttcctatgttgctacgttgactacaggtggaaagacgggcgagcttcgcgtcatgcctctcttcaacggccagccagcagccaccgaagccgcgcagttgacggtcatcgccggagagatgtcatcagcgaactctacgcttgttgcggacaataaggctccgaccgtcaaaacgacgacggaactcaccttcaccgtgaaggatgcgtacgggaacccggtcaccgggctgaagccagatgcaccagtgtttagcggtgccgccagcacggggagtgagcgtccttcagcaggaaactggacagagaaaggtaatggggtctacgtgtcgaccttaacgctgggatctgccgcgggtcagttgtctgtgatgccgcgagtgaacggccaaaatgccgttgctcagccactggtgctgaacgttgcaggtgacgcatctaaggctgagattcgtgatatgacagtgaaggttaataaccaactggctaatggacagtctgctaaccagataaccctgaccgttgtggacacctatggtaacccgttgcaggggcaggaagttacgctgactttaccgcagggtgtgaccagcaagacggggaatacagtaacaactaatgcggcaggtaaagcggacattgagcttatgtcaacggttgcgggagaacacaatatttccgcttcggtgaatggtgctcagaagacggtcacggtgaaattcaacgcggatgccagcaccggtcaggcaaacctgcaggtagacgccgctgctcaaaaagtggcaaacggcaaagatgcctttacgctgacggcgaacgttgaggataaaaatggtaaccctgttccagggagcctggtgacctttaatctgccccggggtgtcaagccgcttacaggcgataatgtctgggtgaaagccaacgatgaggggaaagcagagttgcaggtggtttcagtgactgccggaacgtatgagatcacggcatcggcagggaatagccagccttcgaatacgcagactataacgtttgtagccgataaggctaccgcaaccgtctccggtattgaggtgattggcaactatgcactggcggacggcaatgccaaacagacgtataaagttacggtgactgatgccaataacaacctgttgaaagatagcgaagtgacgctgactgccagcccggcaaatttagttctgactcccaatgggacggcgaaaactaatgagcaaggacaggctattttcaccgccacgaccactgtcgcagcgaaatatacactcacggcgaaagtgagtcaggccgacggtcaggaatcgacgaaaactgccgaatctaaattcgtcgcggatgatacaaatgcagtactcaccgcatcatctgatgtgacttctctggtggcggatgggatatcgactgcgaagctggaggtgacactgatgtcggcaaataaccccgttggggggaatatgtgggtcgacattaagacgccagaaggggtgacggagaaggattatcagttcctgccgtcgaaaaatgaccatttcgtgagcggaaaaatcacgcgtacatttagtaccagcaagcctggtgtctatacgttcacatttaacgccctgacgtatggcgggtacgaaatgaagccagtgacggtgaccattaccgcggtggatgccgatacggcaaagggcgaggaggcgatgaac

SEQ ID NO: 118 - DNA, 4245 bp, Escherichia coli
atgtcacgttataaaacagacaataaacagccacgatttcgttattcagttctggcccgctgcgtggcgtgggcaaatatctctgttcaggttctttttccactcgcagtcacctttacgccagtaatggcagcacgtgcgcagcatgcggttcagccacggttgagcatggaaaatactacggtaactgctgataataacgtggagaaaaatgtcgcgtcgcttgccgctaatgccgggacatttttaagcagtcagccagatagcgatgcgacacgtaactttattaccggaatggccaccgctaaagctaaccaggaaattcaggagtggctcgggaaatacggtactgcgcgcgtcaaactgaatgtcgataaaaatttctcgctgaaggactcttcgctggaaatgctttatccgatttatgatacaccgacaaatatgttgttcactcagggggcaatacatcgtaccgacgatcgtactcagtcaaatattggttttggctggcgtcatttttcagaaaatgactggatggcgggggtgaatacttttatcgatcatgatttatcccgtagtcatacccgcattggtgttggtgcggaatactggcgtgattatttgaaactgagcgccaatggttatatccgggcttctggctggaaaacatcgccggatgttgaggattatcaggaacgcccggcgaatggctgggatattcgtgctgagggctatttacctgcctggccacagcttggcgcaagcctgatgtatgaacagtattatggcgatgaagtcgggctgtttggtaaagataaacgccagaaagatccacatgcgattaccgctgaagtgaattacacgccagtgcctcttctgaccctgagtgccgggcataagcagggcaagagtggtgagaatgacactcgctttggcctggaagttaattatcggattggcgaacctctggaaaaacaactcgatacagacagcattcgcgagcgtcgaatgctggcaggcagccgctatgacctggttgagcgtaataacaatatcgttcttgagtatcgcaaatctgaagtgatccgtattgctctgcctgagcgtattgaaggcaagggcggccagacggtttccctggggcttgtggtcagcaaagcaactcacggtctgaaaaatgtgcaatgggaagcgccgtctttgctggccgcaggcggaaaaattacggggcagggcaatcagtggcaagtgacgctcccggcttatcaggcaggcaaagacaattattatgcgatttcagcgattgcctacgataacaaaggcaatgcctcgaaacgtgtgcagacagaagtggttattagcggagctggtatgagcgccgatcgtacggcgttaacgcttgacggtcagagccgtattcaaatgcttgctaacggtaatgagcaaaagccgttggtgctgtctctgcgcgacgccgaggggcagccagtcacgggcatgaaagatcagatcaagactgaactaaccttcaaaccggctggaaatattgtgactcgttccctgaaggtcactaaatcacaggcaaagccaacactgggtgagttcaccgaaactgaagcaggggtgtatcagtctgtctttactaccggaacgcagtcaggtgaggcaacgattactgttagcgttgatggcatgagcaaaaccgtcactgcagaactgcgggccacgatgatggatgtggcaaactccaccctgagcgctaacgagccgtcaggtgacgtggttgctgatggtcagcaagcctacacgctgacgctgactgcggtggactccgagggtaatccggtgacgggagaagccagccgcctgcgacttgttccgcaagacactaatggtgttaccgttggtgccatttcggaaataaaacctggggtttacagcgccacggtttcttcgacccgtgccggaaacgttgttgtgcgtgccttcagcgagcagtatcagctgggcacattacaacaaacgctgaagtttgttgccgggccgcttgatgcagcacattcgtccatcaccctgaatcctgataaaccggtggttggcggtacagttacggcaatctggacggcaaaagatgctaatgacaaccctgtaactggcctcaatccggatgcaccgtcattatcgggcgcagctgctgctggttctacggcatcaggctggacggataatggcgacgggacctggactgcgcagatttctctcggcactacggcgggtgaattagacgttatgccgaagctcaatgggcaggacgcggcagcaaatgcggcaaaagtaaccgtggtggctgatgcattatcttcaaaccagtcgaaagtctctgtcgcagaagatcacgtaaaagccggtgaaagcacaaccgtaacgctggtggcgaaagatgcgcatggcaacgctatcagaggtctttcgttgtcggcaagtttgacggggaccgcctctgaaggggcgaccgtttccagttggaccgaaaaaggtgacggttcctatgttgctacgttaactacaggcggaaagacgggcgagcttcgtgtcatgccgctcttcaacggccagcctgcagccaccgaagccgcgcagctgactgttattgccggagagatgtcatcagcgaactctacgcttgttgcggacaataaaactccaacggttaaaacgacgacggaactcaccttcaccgtgaaggatgcgtacgggaatccggtcaccgggctgaagccagatgcaccagtgtttagtggtgccgccagcacggggagtgagcgtccttcagcaggaaactggacagagaaaggtaatggggtctacgtgtcgaccttaacgctgggatctgccgcgggtcagttgtctgtgatgccgcgagtgaacggccaaaatgccgttgctcagccactggtgctgaatgttgcaggtgacgcatctaaggctgagattcgtgatatgacagtgaaggttaataaccaactggctaatggacagtctgctaaccagataaccctgaccgtcgtggacagctatggtaacccgttgcaggggcaagaagttacgctgactttaccgcagggtgtgaccagcaagacggggaatacagtaacaaccaatgcggcagggaaagtggacattgagcttatgtcaacggttgcgggagaacacaatatttccgcttcggtgaatggtgctcagaagacggtcacggtgaaattcaacgcggatgccagcaccggtcaggcaaacctgcaggtagacaccgccgttcaaaaagtggcaaacggcaaagatgcctttacgctgacggcaacggttaaggatcaatacggcaaccttcttcctggcgctgtggtcgtctttaatctgcctcggggcgtcaaaccgcttgcagacggtaatatcatggtgaacgccgacaaggagggtaaagcggaactgaaagtggtttccgtgactgccggaacctatgagatcacggcgtcagcaggaaatgaccagccttcgaatgcgcagtctgtaacgtttgtggccgataagactacggcgaccatctccagtattgaggtgattggcaaccgtgcagtggcggacggcaaaaccaaacagacgtataaagttacggtgactgatgccaataacaacctgctgaaagatagcgaagtgacgctgactgccagcccggaaaatttagttctgactcccaatgggacggcgacaacgaatgagcaagggcaggctattttcaccgccacgaccactgtcgcagcgacatatacactcacggcgaaagtggaacaggccgacggtcaggaatcgacgaaaactgccgaatctaaattcgtcgcggatgataaaaacgcggagctcgccgcaacatctgatgtgcattctctggtggcggatggggtaacgacagcaacactgacggtaaccctgttctcggcaaacaacccggtaggaggaaccatgtgggtcgacattgaggctccggaaggggtgacagaggcggattatcagttcctgccgtcgaaaaatgaccatttcgcgagcgggaaaatcacgcgtacatttagtaccaacaagccaggtacatacacattcacattcaactctttgacatatggagggtatgaaatgaaaccagtgactgtgacaattaacgccgttcctgcagatactgaaggcgctgaggagaaa

SEQ ID NO: 119 - DNA, 4254 bp, Escherichia coli
atgtcacattataaaacaggtcataaacaaccacgatttcgttattcagttctggcccgctgcgtggcgtgggcaaatatctctgttcaggttctttttccactcgctgtcacctttaccccagtaatggcggcacgtgcgcagcatgcggttcagccacggttgagcatgggaaatactacggtaactgctgataataacgtggagaaaaatgtcgcgtcgtttgccgcaaatgccgggacatttttaagcagtcagccagatagcgatgcgacacgtaactttattaccggaatggccacagctaaagctaaccaggaaatacaggagtggctcgggaaatatggtactgcgcgcgtcaaactgaatgtcgataaagatttctcgctgaaggattcttcgctggaaatgctttatccgatttatgatacgccgacaaatatgttgttcactcagggggcaatacatcgtacagacgatcgtactcagtcaaatattggttttggctggcgtcatttttcaggaaatgactggatggcgggggtgaatacttttatcgatcatgatttatcccgtagtcatacccgcattggtgttggtgcggaatactggcgcgattatctgaaactgagcgccaatggttatattcgggcttctggctggaaaaaatcgccggatattgaggattatcaggaacgcccggcgaatggctgggatattcgtgctgagggctatttacccgcctggccgcagcttggcgcaagcctgatgtatgaacagtattatggcgatgaagtcgggctgtttggtaaagataagcgccagaaagacccgcatgctatttctgccgaggtgacctatacgccagtgcctcttctgacactgagcgccgggcataagcagggcaagagtggtgagaatgacactcgctttggcctggaagttaattatcggattggcgaacctctggcgaaacaactcgatacagacagcattcgcgagcgtcgggtactggcaggcagccgctatgacctggttgagcgtaataacaacatcgttcttgagtaccgcaaatctgaagtgatccgtattgctctgcctgaacgtattgaaggtaagggtggtcagacactttccctggggcttgtggtcagcaaagcaactcacggactgaaaaatgtgcagtgggaagcgccgtcattactggctgagggtggcaaaattaccggtcagggtagtcagtggcaagtaacgctcccggcttatcgtccaggcaaagacaattattatgcgatttctgcggttgcctacgataacaaaggcaatgcctcaaaacgcgtgcagacagaggtggtcattaccggagcaggtatgagcgccgatcgcacggcgttaacgcttgacggtcagagccgtattcaaatgcttgctaacggtaatgagcaaagaccgctggtgctgtctctgcgcgacgccgaggggcagccagtcacgggcatgaaagatcagatcaagactgaactagccttcaaaccggctggaaatattgtgactcgttccctgaaggccactaaatcacaggcaaagccaacactgggtgagttcaccgaaactgaagcaggggtgtatcagtctgtctttactaccggaacgcagtcaggtgaggcaacgattactgttagcgttgatggcatgagcaaaaccgtcactgcagaactgcgggccacgatgatggatgtggcaaactccaccctgagcgctaacgagccgtcaggtgatgtggttgctgatggtcagcaagcctatacgttgacgttgactgcggtggactccgagggtaatccggtgacgggagaagccagccgcttgcgatttgttccgcaagacactaatggtgtaaccgttggtgccatttcggaaataaaaccaggcgtttacagcgccacggtttcttcgacccgtgccggaaacgttgttgtgcgtgctttcagcgagcagtatcagctgggcacattacaacaaacgctgaagtttgttgccggtccgcttgatgcagcacattcgtccatccccctgaatcctgataaaccggtggttggcggtacagttacggcaatctggacggcaaaagatgcctatgacaaccctgtgaccagcctcacgccggaagcgccgtcattagcgggtgccgctgctgtaggttctacggcatctggctggacaaataatggtgatgggacgtggactgcgcagattactctcggctctacggcgggtgaattagaagttatgccgaagctaaatggacaggatgcggcagcaaatgcggcaaaagtaaccgtggtggctgatgcgttatcttcaaaccagtcgaaagtctctgtcgcagaagatcacgtaaaagccggcgaaagcacaaccgtgacgcttattgcaaaagatgcacatggcaacactatcagtggtctttcgttgtcggcaagtttgacggggaccgcctctgaaggggcgaccgtttccagttggaccgaaaaaggtgactgttcctatgttgctacgttaactacaggcggaaagacgggcgagcttcgtgtcatgccgctcttcaacggccagccagcagccaccgaagccgcgcagttgacggtcatcgccggagagatgtcatcagcgaactctacgcttgttgcggacaataaggctccgaccgtcaaaatgacgacggaactcaccttcaccgtgaaggatgcgtacgggaacccggtcaccgggctgaagccagatgcaccagtgtttagcggtgccgccagcacggggagtgagcgtccttcagcaggaaactggacagagaaaggtaatggggtctacgtggcgaccttaacgctgggatctgccgcgggtcagttgtctgtgatgccgcgagtgaacggccaaaatgccgttgctcagccactggtgctgaacgttgcaggtgacgcatctaaggctgagattcgtgatatgacagtgaaggttaataaccaactggctaatggacagtctgctaaccagataaccctgaccgtcgtggacagctatggtaacccgttgcaggggcaagaagttacgctgactttaccgcagggtgtgaccagcaagacggggaatacagtaacaaccaatgcggcagggaaagtggacattgagcttatgtcaacggttgcgggggaacacagcatcacggcctcagtgaataatgctcagaagacggttacggtgaaattcaaggcggatttcagtaccggtcaggcgaccctggaggttgatggcagcacgccaaaagtggcaaacgacaatgatgcctttacgctgacggcaacggttaaggatcaatacggcaaccttctgcctggcgctgtggtcgtctttaatctgcctcggggcgtcaaaccgcttgcagacggtaatatcatggtgaacgccgacaaggagggtaaagcggaactgaaagtggtctccgtgactgccggaacgtatgagatcacggcgtcggcaggaaatgaccagccttcgaatgcgcagtctgtaacgtttgtggccgataagactacggcgaccatctccagtattgaggtgattggcaaccgtgcagtggcggatggcaaaaccaaacagacgtataaagttacggtgactgatgccaataacaacctgttgaaggatagcgacgtgacgctgactgccagctcggaaaatttagttctggatcctaaagggacggcgaaaactaatgagcaaggacaggctgttttcaccggctctaccactatcgcagcgacatatacactcacggcgaaagtggaacaggccaacggtcaggtatcgacgaaaactgctgaatctaaattcgtcgcggatgataaaaacgcggtgctcgccgcatctccagaacgtgtagattctctggtggcggacgggaagactactgcaacaatgacggttaccctgatggcgggagtcaatcccgtaggaggaagtatgtgggtcgacattgaggctccggaaggagtgacggagaaggattatcaattcctgccgtcgaaggctgaccatttctcaggtgggaaaatcacgcgtacatttagtaccagcaagccaggtgtctatacgttcacattcaacgcactgacgtatggcgggtacgaaatgacgcctgtgaaggtgacaattaacgccgttgctgcagagactgaaaatggcgaggaggagatgcca

SEQ ID NO: 120 - DNA, 4251 bp, Escherichia coli
atgtcgcgttataaaacagatcataaacaaccacgatttcgttattcagttctggcccgctgcgtggcgtgggcaaatatctctgttcaggttctttttccactcgctgtcacctttaccccagtaatggcggcacgtgcgcagcatgcggttcagccacggttgagcatgggaaatactacggtaactgctgataataacgtggagaaaaatgtcgcgtcgtttgccgcaaatgccgggacatttttaagcagtcagccagatagcgatgcgacacgtaactttattaccggaatggccacagctaaagctaaccaggaaatacaggagtggctcgggaaatatggtactgcgcgcgtcaaactgaatgtcgataaagatttctcgctgaaggattcttcgctggaaatgctttatccgatttatgatacgccaacaaatatgttgttcactcagggagcaatacatcgtaccgacgatcgtactcagtcaaatattggttttggctggcgtcatttttcaggaaatgactggatggcgggggtgaacacctttatcgaccatgatttatcccgtagtcatacccgcattggtgttggtgcggaatactggcgcgattatctgaaactgagcgccaatggttatattcgggcttctggctggaaaaaatcgccggatattgaggattatcaggaacgcccggcgaatggttgggatatccgcgcagagggctatttacctgcctggccgcagcttggcgcaagcctgatgtatgaacagtattatggcgatgaagtcgggctgtttggtaaagataagcgccagaaagacccgcatgctatttctgccgaggtgacctatacgccagtgcctcttctgacactgagcgccgggcataagcagggcaagagcggtgagaatgacactcgctttggcctggaagttaattatcggattggcgaacctctggagaaacaactcgatacagacagcattcgcgagcgtcgaatgctggcaggcagccgctatgacctggttgagcgtaataacaacatcgttcttgagtaccgcaaatctgaagtgatccgtattgctctgcctgagcgtattgaaggtaagggcggtcagacactttccctggggcttgtggtcagcaaagcaactcacggactgaaaaatgtgcagtgggaagcgccgtcattactggctgaaggtggcaaaattaccggtcagggtagtcagtggcaagtaacgctcccggcttatcgtccaggcaaagacaattattatgcgatttctgcggttgcctacgataacaaaggcaatgcctcaaaacgcgtgcagacagaggtggtcattaccggagcaggtatgagtgccgatcgcacggcgttaacgcttgacggtcagagccgtattcaaatgcttgctaacggtaatgagcaaagaccgctggtgctgtctctgcgcgacgccgagggccagccagtcacgggcatgaaagatcagatcaagactgaactaactttcaaaccggctggaaatattgtgactcgtaccctgaaggccactaaatcacaggcaaagccaacactgggtgagttcaccgaaactgaagccggggtgtatcagtctgtctttactaccggaacgcagtcaggtgaggcaacgattactgttagtgttgatggcatgagcaaaaccgtcactgcagaactgcgggccacgatgatggatgtggcaaactccaccctgagcgctaacgagccgtcaggtgacgtggttgctgatggtcagcaagcctacacgctgacgctgactgcggtggatactgatggtaacccggtgacgggagaggccagccgcttgcgatttgttccgcaagacactaatggtgtcaccattggtacaatttcggagataaaaccaggcgtttacagcgccacggtttcttcgacccgtgccggaaacgttgttgtgcgtgctttcagcgagcagtatcagctgggcacattacaacaaacgctgaagtttgttgccgggccgcttgatgcagcacattcgtccatcacactgaatcctgataaaccggtggttggcggtacagttacggcaatctggacggcaaaagatgctaatgacaaccctgtaactggtctcaatccggatgcaccgtcattatcgggcgcagctgctgctggttctacggcatcaggctggacggataatggcgacgggacctggactgcgcagatttctctcggcactacggcgggtgaattagaggttattccgaagctaaatggacaggatgcggcagcaaatgcggcaaaagtaaccgtggtggctgatgcgttatcttcaaaccagtcgaaagtctctgtcgcagaagatcacgtaaaagccggcgaaagcacaaccgtgacgcttattgcaaaagatgcacatggcaacgctatcagtggtctttccctgtcggcaagcctgacgggtgctgcgtctgaaggggcgactgtttctggttggaccgaaaaaggtgatggttcctatgtcgctacgctgacaacaggtggaaagacgggtgagcttctcgtcatgccgctattcaacggccagccagcagccaccgaagccgcgcagttgactgtcattgcgggggagatgtcatcagcgaactctacgcttgttgctgacaataaggctccgaccgtcaaaacgacgacgaaactcaccttcaccgtgaaggatgcgtacgggaaccttgtcaccgggctgaagccagatgcaccgcagtttagtggtgccgccagcacggggacagagcgaccttcaacaggagactggacagaaacaagtaatggggtctacgtggcgaccttgactctgggatctgccgcgggccagttgtctgtgatgccgcgagtgaacggccaaaatgccgttgctcagccactggtgctgaatgttgctggtgacgcatctaaggctgagattcgtgatatgacggtgaaggttgataaccagctggctaatggacaatcgactaaccaggtaaccctgaccgttgtggacacctatggtaacccgttgcagggacaaaatgtgacgctgactctgccgaaaggtgtgaccagcaagacggggaatacggtaacaaccgatgcggcaggtaaagccgacattgagctgatgtcaacggttgccggggaacacagcatcacggcctcagtgaataatgctcagaagacggttacggtgaaattcaaggcggatttcagtaccggtcaggcgagtctggaggttgatagcgccgcgccaaaagtagcaaacggcaaagatgcctttacgctgacggcgaccgttgaggataaaaatggtaaccctgttccagggagcctggtgacctttaatctgccccggggtgtcaagccgcttacaggcgataatgtctgggtgaaagccaacgatgaggggaaagcagagttgcaggtggtttcagtgactgccggaacgtatgagatcacggcatcggcggggaatagccagccttcggatacgcagactataacgtttgtagccgataaggctaccgcaaccgtctccggtattgaggtgattggcaactatgcgctggcggacggcaaagccaaacaaacgtataaagttacggtgactgatgccaataacaatttggtgaaagatagcgacgtgacgctgactgccagcccggcttcgttaaacctggaaccgaatggcactgcgacaacgaatgagcaagggcaggctattttcaccgctaccactactgttgcggcgacatacacactcaaggcgcaagtgagtcagaccaacggtcaggtatcaacgaaaactgccgaatctaaattcgttgcggatgataaaaacgcggtactcaccgcatcatctgatatgcaatctctggtggcggatgggaaatcgactgcgaagctggaggtgacactgatgtcggcaaacaaccccgttggcgggaatatgtgggtcgacattcagacgccggaaggggtgacggagaaggattatcagttcctgccgtcgaaaaatgaccatttcgtgagcggaaaaatcacgcgtaaatttagtaccagcaagcctggtgtctatacgttcacatttaacgccctgacctatggcgggtacgaaatgaagccagtgacggtgaccattaccgcggtggatgccgatacggcaaaggacgaggaggcgatgaaa

SEQ ID NO: 121 - DNA, 4248 bp, Escherichia coli
atgtcacgttataaaacagacaataaacagccacgatttcgttattcagttctggcccgctgcgtggcgtgggcaaatatctctgttcaggttctttttccactcgctgtcacctttacgccagtaatggcagcacgtgcgcagcatgcggttcagccacggttgagcatggaaaatactacggtaactgctgataataacgtggagaaaaatgtcgcgtcgcttgccgctaatgccgggacatttttaagcagtcagccagatagcgatgcgacacgtaactttattaccggaatggccaccgctaaagctaaccaggaaattcaggagtggctcgggaaatacggtactgcgcgcgtcaaactgaatgtcgataaaaatttctcgctgaaggactcttcgctggaaatgctttatccgatttatgatacaccgacaaatatgttgttcactcagggggcaatacatcgtaccgacgatcgtactcagtcaaatattggttttggctggcgtcatttttcagaaaatgactggatggcgggggtgaatacttttatcgatcatgatttatcccgtagtcatacccgcattggtgttggtgcggaatactggcgtgattatttgaaactgagcgccaatggttatatccgggcttctggctggaaaaaatcgccggatgttgaggattatcaggaacgcccggcgaatggctgggatattcgtgctgagggctatttacctgcctggccgcagcttggcgcaagcctgatgtatgaacagtattatggcgatgaagtcgggctgtttggtaaagataaacgccagaaagatccacatgcgattaccgctgaagtgaattacacgccagtgcctcttctgaccctgagtgccgggcataagcagggcaagagtggtgagaatgacactcgctttggcctggaagttaattatcggattggcgaacctctggaaaaacaactcgatacagacagcattcgcgagcgtcgaatgctggcaggcagccgctatgacctggttgagcgtaataacaatatcgttcttgagtatcgcaaatctgaagtgatccgtattgctctgcctgagcgtattgaaggcaagggcggccagacggtttccctggggcttgtggtcagcaaagcaactcacggtctgaaaaatgtgcaatgggaagcgccgtctttgctggccgcaggcggaaaaattacggggcagggcaatcagtggcaagtgacgctcccggcttatcaggcaggcaaagacaattattatgcgatttcagcgattgcctacgataacaaaggcaatgcctcgaaacgtgtgcagacagaagtagttattagcggagctggtatgagcgccgatcgtacggcgttaacgcttgacggtcagagccgtattcaaatgcttgctaacggtaatgagcaaaagccgctggtgctgtctctgcgcgacgccgagggccagccagtcacgggcatgaaagatcagatcaagactgaactaaccttcaaaccggctggaaatattgtgactcgtaccctgaaggccactaaatcacaggcaaagccaacactgggtgagttcaccgaaactgaagcaggggtgtatcagtctgtctttactaccggaacgcagtcaggtgaggcaacgattactgttagcgttgatgacatgagcaaaactgtcactgcagaactgcgggccacgatgatggatgtgtcaaactccaccctgagtgctaacgagccgtcaggtgatgtggttgctgatggtcagcaagcctacacgctgacactgacagcggtggactccgagggtaatccggtgacgggagaagccagccgcctgcgacttgttccgcaagacactaatggtgtaaccgttggtgccatttcggaaataaaaccaggggtttacagcgccacggtttcttcgacccgtgccggaaacgttgttgtgcgtgccttcagcgagcagtatcagctgggcacattacaacaaacgctgaagtttgttgccgggccgcttgatgcagcacattcgtccatcacactgaatcctgataaaccggtggttggcggtacagttacggcaatctggacggcaaaagatgctaatgacaaccctgtaactggcctcaatccggatgcaccgtcattatcgggcgcagctgctgctggttctacggcatcaggctggacggataatggcgacgggacctggactgcgcagatttctctcggcactacggcgggtgaattagacgttatgccgaagctcaatgggcaggacgcggcagcaaatgcggcaaaagtaaccgtggtggctgatgcattatcttcaaaccagtcgaaagtctctgtcgcagaagatcacgtaaaagccggtgaaagcacaaccgtaacgctggtggcgaaagatgcgcatggcaacgctatcagtggtctttcgttgtcggcaagtttgacggggaccgcctctgaaggggcgaccgtttccagttggaccgaaaaaggtgacggttcctatgttgctacgttaactacaggcggaaagacgggcgagcttcgtgtcatgccgctcttcaacggccagcctgcagccaccgaagccgcgcagctgactgttattgccggagagatgtcatcagcgaactctacgcttgttgcggacaataaaactccaacggttaaaacgacgacggaactcaccttcaccatgaaggatgcgtacgggaatccggtcaccgggctgaagccagatgcaccagtgtttagtggtgccgccagcacggggagtgagcgtccttcagcaggaaactggacagagaaaggtaatggggtctacgtgtcgaccttaacgctgggatctgccgcgggtcagttgtctgtgatgccgcgagtgaacggccaaaatgccgttgctcagccactggtgctgaatgttgcaggtgacgcatctaaggctgagattcgtgatatgacagtgaaggttaataaccaactggctaatggacagtctgctaaccagatcaccctgaccgtcgtggacagctatggtaacccgttgcaggggcaagaagttacgctgactttaccgcagggtgtgaccagcaagacggggaatacagtaacaaccaatgcggcagggaaagtggacattgagcttatgtcaacggttgcaggggaacttgagatcgaggcctcggtgaaaaactctcagaagacggtcaaggtgaaattcaaggcggatttcagtaccggtcaggcgagcctggaggtagacgccgctgctcaaaaagtggcaaacggcaaagatgcctttacgctgacggcaacggttaaggatcaatacggcaaccttcttcctggcgctgtggtcgtctttaatctgcctcggggcgtcaaaccgcttgcagacggtaatatcatggtgaacgccgacaaggagggtaaagcggaactgaaagtggtttccgtgactgccggaacctatgagatcacggcgtcagcaggaaatgaccagccttcgaatgcgcagtctgtaacgtttgtggctgataagactacggcgaccatctccagtattgaggtgattggcaaccgtgcagtggcggacggcaaaaccaaacagacgtataaagttacggtgactgatgccaataacaacctgctgaaagatagcgaagtgacgctgactgccagcccggaaaatttagttctgactcccaatgggacggcgacaacgaatgagcaagggcaggctattttcaccgccacgaccactgtcgcagcgacatatacactcacggcgaaagtggaacaggccgacggtcaggaatcgacgaaaactgccgaatctaaattcgtcgcggatgataaaaacgcggtgctcgctgcatctccagagcgtgtagattctctggtggcggacgggaagactactgcaacactgacggttactctgatgtcgggtgtcaaccccgtaggaggaaccatgtgggtcgacattgaggctccggaaggggtgacagaggcggattatcagttcctgccgtcgaaaaatgaccatttcgcgagcgggaaaatcacgcgtacatttagtaccaacaagccaggtacatacacattcacattcaactctttgacatatggagggtatgaaatgaaaccagtgactgtgacaattaacgccgttcctgcagatactgaaggcgctgaggagaaa

SEQ ID NO: 122 - DNA, 4251 bp, Escherichia coli
atgtcacgttataaaacaggtcataaacaaccacgatttcgttattcagttctggcccgctgcgtggcgtgggcaaatatctctgttcaggttcttttcccactcgctgtcacctttaccccagtaatggcagcacgcgcgcagcatgcggttcagccacgtttgagcatggaaaataccacagtagctgctgataataatgtggagaaaaatgtcgcgtcgtttgccgcaaatgccgggacatttttaagcagtcagccagatagcgatgcgacacgtaactttattaccggaatggccacagctaaagctaaccaggaaatacaggagtggctcgggaaatatggtactgcgcgcgtcaaactgaatgtcgataaagaattctcgctgaaggattcttcgctggaaatgctttatccgatttatgatacgccgacaaatatgttgttcactcagggagcaatacatcgtaccgacgatcgtactcagtcaaatattggttttggctggcgtcatttttcaggaaatgactggatggcgggggtgaacacctttatcgaccatgatttatcccgtagtcatacccgcattggtgttggtgcggaatactggcgtgattatttgaaattgagcgccaatggttatatccgggcttctggctggaaaaaatcgccggatgttgaggattatcaggaacgcccggcgaatggctgggatattcgtgctgagggctatttacctgcctggccgcagcttggcgcaagcctgatgtatgaacagtattatggcgatgaagtcgggctgtttggtaaagataaacgccagaaagatccacatgcgattaccgctgaagtgaattacacgccagtgcctcttctgaccctgagtgccgggcataagcagggcaagagtggtgagaatgacactcgctttggcctggaagttaattatcggattggcgaacctctggaaaaacaactcgatacagacagcattcgcgagcgtcgaatgctggcaggcagccgctatgacctggttgagcgtaataacaatatcgttcttgagtatcgcaaatctgaagtgatccgtattgctctgcctgagcggattgaaggtaagggcggtcagacactttccctgggacttgtggtcagcaaagcaactcacggactgaaaaatgtgcagtgggaagcgccgtcattactggctgaaggtggcaaaattaccggtcagggtagtcagtggcaagtaacgctcccggcttatcgtccaggcaaagacaattattatgcggtttcagcgattgcctacgataacaaaggcaatgcctcgaaacgtgtgcagacagaagtggttattagcggagctggtatgagcgccgatcgtacggcgttaacgcttgacggtcagagccgtattcaaatgcttgctaacggtaatgagcaaaagccgctggtgctgtctctgcgcgacgccgagggccagccagtcacgggcatgaaagatcagatcaagactgaactaaccttcaaaccggctggaaatattgtgactcgtaccctgaaggccactaaatcacaggcaaagccaacactgggtgagttcaccgaaactgaagcaggggtgtatcagtctgtctttactaccggcacgcagtcaggtgaggcaacgattactgttagcgttgatggcatgagcaaaaccgtcactgcagaactgcgggccacgatgatggatgtggcaaactccaccctgagcgctaacgagccatcaggtgacgtggttgctgatggtcagcaagcctacacgctgacactgacagcggtggactccgagggtaatccggtgacgggagaagccagccgcctgcgacttgttccgcaagacactaatggtgtaaccgttggtgccatttcggaaataaaaccaggggtttacagcgccacggtttcttcgacccgtgccggaaacgttgttgtgcgtgccttcagcgagcagtatcagctgggcacattacaacaaacgctgaagtttgttgccgggccgcttgatgcagcacattcgtccatcaccctgaatccggataaaccggtggtcggcggtacagttacggcaatctggacggcaaaagatgccaatgacaaccctgtaacaggcctcaatccggatgcaccgtcattatcgggcgcagcagctgctggttctacggcatctggctggacaaataatggtgatgggacgtggactgcgcagattactctcggctctacggcgggtgaattagaagttatgccgaagctaaatggacaggatgcggcagcaaatgcggcaaaagtaaccgtggtggctgatgcattatcttcaaaccagtcgaaagtctctgtcgcagaagatcacgtaaaagccggtgaaagcacaaccgtaacgcttattgcaaaagatgcgcatggcaacgctatcagtggtctttcgttgtcggcaagtttgacggggaccgcctctgaaggggcgaccatttccagttggaccgaaaaaggtgacggttcctatgttgctacgttgaccacaggcggaaagacgggcgagcttcgtgtcatgcctctcttcaacggccagccagcagccaccgaagccgcgcagttgacggtcatcgccggagagatgtcatcagcgaactctacgcttgttgcggacaataagactccaacggttaaaacgacgacggaactcaccttcaccgtgaaggatgcgtacgggaacccggtcaccgggctgaagccagatgcaccagtgtttagcggtgccgccagcacgggatcagcgcgaccttcagcaggaagctggacagagcaaagtaatggggtctacgtggcgaccttaacgctgggatcggctgcaggtcagttgtctgtgatgccgcgagtgaacggccaaaatgccgttgctcagccactggtgctgaatgttgcaggcgacgcttcccgggcagtgatcagtgatatggcggtgaaggtgaataaccaactggcaaatggacagtctgctaaccaggtaaccctgaccgtcgtggacagctatggtaacccgttgcaggggcaagaagttacgctgactttaccgcagggtgtgactagcaagacggggaatacagtaacaaccaatgcggcaggtaaggcggatattgagttgatatcaaccgttgcaggggaacttgaaatcgcggccgcggtgaaaaactctcagaagacggtcacggtgaaattcaacgcggatgccagcaccggtcaggcaaacctgcaggtagacaccgccgttcaaaaagtggcaaacggcaaagatgcctttacgctgacggcgaccgttgaggataaaaacggtaaccctgttccaggcactctggtgacctttaatctgccccggggtgtcaagccgcttactggcgataatgtctgggtgaaagccaacgatgaggggaaagcagagttgcaggtggtttccgtgactgccggaacctatgagatcacggcgtcggcaggaaatgaccagccttcagatgcgcagactataacgtttgtagccgataaggctaccgcaaccgtctccggtattgaggtgattggcaactatgcactggcggacggcaaagccaaacagacgtataaagttacggtgactgatgccaataacaacctgttgaaagatagcgacgtgacgctgactgccagcccggcttcgttaaacctggaaccgaatggcactgcgacaacgaatgagcaagggcaggctattttcaccgctaccactactgttgcggcgacatacacactcaaggcgcaagtgagtcagaccaacggtcaggtatcaacgaaaactgccgaatctaaattcgtcgcggatgataaaaacgcggagctcaccgcatcatctgatgtgcaatcgctggtggcggatgggaaatcgactgcgaagctggaggttaccctgttctcggcaaataaccctgttggggggaatgtgtgggtcgacattgaggctccggaaggagtgacggagaaggattatcaattcctgccgtcgaaaaatgaccatttcgtgagcggaaaaatcacgcgtacatttagtaccagcaagcctggtgtctatacgttcacatttaacgccctgacctatggcgggtacgaaatgaagccagtgacggtgaccataaccgcggtggatgccgatacggcaaagggcgaggaggcgatgaag

SEQ ID NO: 123 - DNA, 4251 bp, Escherichia coli
atgtcacgttataaaacaggtcataaacaaccacaatttcgttattcagttctggcccgctgcgtggcgtgggcaaatatctctgttcaggttctttttccactcgctgtcacctttaccccagtaatggcggcacgtgcgcagcatgcggttcagccacggttgagcatgggaaatactacggtaactgctgatagtaacgtggagaaaaatgtcgcgtcgtttgccgcaaatgccgggacatttttaagcagtcagccagatagcgatgcgacacgtaattttattaccggaatggccaccgctaaagctaaccaggaaatacaggagtggctcgggaaatatggtacagcgcgcgtcaaactgaatgtcgataaagatttctcgctgaaggattcttcgctggaaatgctttatccgatttatgatacgccgacaaatatgttgttcactcagggggcaatacatcgtacagacgatcgtactcagtcaaatattggttttggctggcgtcatttttcaggaaatgactggatggcgggggtgaatacttttatcgatcatgatttatcccgtagtcatacccgcattggtgttggtgcggaatactggcgcgattatttgaaactgagcgccaatggttatattcgggcttctggctggaaaaaatcgccggatattgaggattatcaggaacgcccggcgaatggttgggatatccgcgcagagggctatttacctgcctggccgcagcttggcgcaagcctgatgtatgaacagtattatggcgatgaagtcgggctgtttggtaaagataaacgccagaaagacccgcatgctatttctgccgaggtaacctatacaccagtgcctcttctgacactgagcgccgggcataagcagggcaagagcggtgagaatgacactcgctttggcctggaagttaactaccgaattggcgaacctttggcgaaacaactcgatacggatagcattcgcgagcgtcgaatgctggcaggcagccgctatgacctggttgagcgtaataacaacatcgttcttgagtatcgcaaatctgaagtgatccgtattgctctgcctgaccgtattgcaggtaagggcgggcagacggtttccctgggacttgtggtgagtaaagcaactcacggtctgaaaaatgttcaatgggaagcgccgtctttgctggccgcaggcggaaaaattacggggcagggtaatcagtggcaagtgacgctcccggcttaccaggcaggcaaagacaattattatgcgatttctgcggttgcctacgataacaaaggcaatgcctcaaaacgcgtgcagacagaggtggtcattaccggagcaggtatgagtgccgagcgcacggcgttaacgcttgacggtcagagccgtattcaaatgcttgctaacggtagtgagcaaaagccactggtgctttctctgcgagacgccgaggggcagccagtcacgggcatgaaagatcagatcaagactgagctgacgttcaagccagctggaaatattgtgactcgtaccctgaaggccactaaatcacaggcacagccaacactgggtgagttcaccgaaactgaagcaggggtgtatcagtctgtctttactaccggaacgcagtcaggtgaggcaacgattactgttagcgttgatgacatgagcaaaactgtcactgcagaactgcgggccacgatgatggatgtggcaaactccaccctgagcgctaacgagccgtcaggtgatgtggttgctgatggtcagcaatcccacacgctgacgcttactgcggtggatactgatggtaacccggtgacgggagaagccagccgcctgcgacttgttccgcaagacactaatggtgtaaccgttggtgccatttcggaaataaaaccaggggtttacagcgccacggtttcttcgacccgtgccggaaacgttgttgtgcgtgccttcagcgagcagtatcagctgggcacattacaacaaacgctgaagtttgttgccgggccgcttgatgcagcacattcgtccatcaccctgaatcctgataaaccggtggttggcggtacagttacggcaatctggacggcaaaagatgcctatgacaaccctgtgaccagcctcacgccggaagcgccgtcattagcgggtgctgcggctgtaggttctacggcatctggctggacaaataatggtgatggaacgtggactgcgcagattactctcggctctacggcgggtgaattagacgttatgccgaagctaaatggacaggatgcggcagcaaatgcggcaaaagtaaccgtggtggctgatgcattatcttcaaaccagtcgaaagtctctgtcgcagaagatcacgtaaaagccggtgaaagcacaaccgtaacgcttattgcaaaagatgcacatggcaacgctatcagtggtctttccctgtcggcaagcctgacgggtgctgcgtctgaaggggcgactgtttccagttggaccgaaaaaggtgatggttcctatgtcgctacgctgacaacaggtggaaagacgggtgagcttctcgtcatgccgctattcaacggccagccagcagccaccgaagccgcgcagctgactgttattgccggagagatgtcatcagcgaactctacgcttgttgcggacaataaggctccgaccgtcaaagcgacgacggaacttaccttcaccgcgaaggatgcgtatgggaaccctgttagtggcctgaagctcgatgcaccagtgtttagcggtgccgccagcacgggatcagagcgaccttcagcaggaagctggacagagcaaagtaatggggtctacgtggcgaccttaacgctgggatcggctgcaggccagctatcagtcatgccgcgcgtgaacggccaaaatgccgttgctcaaccactggtgctgaatgttgctggtgacgcatctaaggctgagattcgtgatatgacagtgaaggttgataaccagctggcaaatggacagtcgactaaccaggtaaccctgaccgttgtggacacctatggtaacccgttgcaggggcaagaagttacgctgactttaccgcagggtgtgaccagcaagacggggaatacagtaacaaccaatgcggcaggtaaagcggatattgagttgatatcaaccgttgcaggggaacttgaaatcgcggccgcggtgaaaaactctcagaagacggtcacggtgaaattcaacgcggatgccagcaccggtcaggcaaacctgcaggtagacgccgctgctcaaaaagtggcaaacggcaaagatgcctttacgctgacggcgaacgttgaggataaaaatggtaaccctgttccagggagcctggtgacctttaatctgccccggggtgtcaagccgcttacaggcgataatgtctgggtgaaagccaacgatgaggggaaagcagagttgcaggtggtttccgtgactgccggaacctatgagatcacggcatcggcaggaaatgaccagccttcggatgcgcagactataacgtttgtagccgataagactaccgcaaccgtctccggtattgaggtgattggcaactatgctctggcggacggcaaagccaaacagacgtataaagttacggtgactgatgccaataacaacctgttgaaagatagcgaggtgacgctgactgccagcccggcaaatttagctctggatcccgatgggacggcgaaaactaatgagcaagggcaggctattttcaccgccacgaccactgtcgcggcgaaatatacactcacggcgaaagtggaacaggccaacggtcaggaatcgacgaaaactgctgaatctaaattcgtcgcggatgataaaaacgcggtgctcgccgcatcatctgatgtgacttctctggtggcggatggggtacagaccgcaacaatgacggttaccctgttctcggcaaataaccctgttggggggaatgtgtgggtcgacattgaggctccggaaggagtgacggagaaggattatcaattcctgccgtcgaaaaatgaccatttcgtgagcggaaaaatcacgcgtacatttagtaccaacaagccaggtacatacacattcacattcaactctttgacatatggagggtatgaaatgaaaccagtgactgtgaccattaccgcggtggatgccaatacggcaacgggcgaggaggcgatgaaa

SEQ ID NO: 124 - DNA, 2844 bp, Escherichia coli
atgaaacgacatctgaacaccagctacaggctggtatggaatcacattacgggcaccctggtggtggcctccgaactggcccgctcacggggaaaacgcgccggtgtggcggttgcactgtctcttgctgctgtcacatcagtcccggcactggctgctgacacggttgtacaggcgggagaaaccgtgaacgacggaacactgacaaatcatgacaaccagattgtcctcggtacggccaacggaatgaccatcagtaccgggctggagtatgggccggataacgaggccaataccggcggacaatggatacaaaatggcggtatcgccaacaacactactgtcaccggtggtggtcttcagagagtgaatgccggaggaagcgtttcagacacggttatcagtgccggaggaggacagagccttcaggggcaggcagtgaacaccactctgaacggcggtgagcagtgggtacatgaaggcgggattgcaacgggtaccgtcattaatgagaagggctggcaggccgtcaaatccggcgcaatggcaaccgacacggttgtgaataccggcgcggaagggggaccggatgcagaaaatggtgataccgggcagtttgttcgcggaaatgccgtacgtaccactatcaatgagaatggtcgtcagattgtggctgctgaaggaacggcaaataccactgtggtttatgccggcggcgaccagactgtacatggctacgcgctggataccacactgaacggcggtaaccagtatgtgcacaacggcggtacagcgtctggcactgttgtgaacagtgacggctggcagattgtcaaggaaggtggtctggcggatttcaccatcgttaaccagaaaggcaaactgcaggtgaacgccggtggtacagccacgaatgtcaccctgaagcagggaggcgcactggtcaccagtacggcggcaaccgtcaccggcagcaaccgtctgggcaatttcacggtggaaaacggtaatgctgacggtgttgttctggagtccggtggtcgcctggatgtactggagggccattcagcctggaaaacactggtggatgacggcggtaccctggcagtgtctgccggtggtaaggcaacagatgtcaccatgacatccggtggtgccctgattgcagacagtggtgccactgttgaggggaccaatgccagcggtaagttcagtattgatggcatatccggtcaggccagcggcctgctgctggaaaatggtggcagctttacggttaatgccgggggacaggctggcaacaccactgtcggacatcgtggaacactgacgctggctgccgggggaagtctgagtggcagaacacagctcagtaaaggcgccagtatggtactgaatggtgatgtggtcagtaccggcgatattgttaacgcaggagagattcactttgataatcagacgacaccggatgccgcgctgagccgtgctgttgcaaaaggcgactccccggtaacgttccataaactgaccaccagtaacctcaccggtcagggtggcaccatcaatatgcgtgttcgccttgatggcagtaatacctcagaccagctggtgattaatggtggtcaggcaaccggcaaaacctggcttgcgttcacaaatgtcggaaacagtaacctcggggtggcaaccaccggacagggtatccgggttgtggatgcacagaatggtgccaccacagaagaaggtgcgtttgccctgagtcgcccgcttcaggccggcgcctttaactacaccctgaaccgtgacagcgatgaagactggtacctgcgcagtgaaaatgcttatcgtgcagaagtccccctgtatgcctccatgctgacacaggcaatggactatgaccggattctggcaggctcccgcagccatcagaccggtgtaaatggtgaaaacaacagcttccgtctcagcattcagggcggtcatctcgggcacgttaacaacggtggtattgcccgtggggccacgccggaaagcagcggcagctatggcctcgtccgtctggagggtgacctgctgagaacagaggttgccggtatgtcactgacgacaggagtgtatggtgctgcaggccattcttccgttgatgttaaggatgatgacggctcccgtgccggcacggtccgggatgatgccggcagtctgggcggatacctgaatctggtacacacgtcctccggcctgtgggctgacattgtggcacagggaacacgccacagcatgaaagcgtcatcggacaataacgacttccgcgcccggggctggggctggctgggctcactggaaactggtctgcccttcagtatcactgacaacctgatgctggagccacaactgcagtatacctggcagggactttccctggatgacggccaggataacgccggttatgtgaagttcgggcatggcagtgcacaacatgtgcgtgccggcttccgtctgggcagccacaacgatatgaactttggtaaaggcacctcatcccgtgacaccctgcgcgacagtgcaaaacacagtgtgcgtgaactgccggtgaactggtgggtacagccttctgttatccgcaccttcagctcccggggggacatgagcatgggtacagccgcagccggcagtaacatgacgttctcaccgtcccagaatggcacgacactggacctgcaggccggactggaagcccgtgtccgggaaaatatcaccctgggcgttcaggccggttatgcccacagtgtcagcggcagcagcgctgaaggttataacggtcaggccacgctgaatgtgactttc

SEQ ID NO: 125 - DNA, 2847 bp, Escherichia coli
atgaaacgacatctgaacaccagctacaggctggtatggaatcacattacgggcaccctggtggtggcttccgaactggcccgctcacggggaaaacgcgccggtgtggcggttgctctgtctcttgctgctgtcacgtcagtcccggcactggctgctgacacggttgtacaggctggggaaaccgtgaacggcggaacactgacaaatcatgacaaccagattgtcctcggtacggccaacggaatgaccatcagtaccgggctggaactggggccggacagtgaagaaaacaccggtgggcaatggatacagaatggcgggatagccggcaacaccactgtcaccacaaatggtcgtcaggtcgtgctggaggggggaacagccagtgatacggttattcgtgacggcgggggacagagcctgaacgggctggcggtgaacaccacgctgaataacagaggcgagcagtgggttcatgagggcggggttgccaccggtacaattatcaaccgcgacggttaccagagcgttaaaagtggcgggctggcaacaggaaccatcatcaacaccggcgcagaaggcggcccggattctgacaactcgtacacgggtcagaaggtccagggaacagcagaatccaccaccatcaacaaaaatggacggcagattatcttattttccgggatagcccgtgacactctcatttacgcaggtggtgaccagtcggtacacggaagggccctgaataccacactgaatggcggttaccagtatgtgcacaaggacggacttgcgctgaacacggtaattaacgaggggggctggcaggttgttaaggcaggtggtgctgtcggtaacaccaccataaatcagaacggtgaactgagggtacatgccggcggggaagccactgcagtcacccagaacacgggcggtgcactggttaccagtactgctgcaactgtcaccggcgcaaaccgcctggggcatttctccgtgggaaatggcatggcagataacgtcgttctggaaaatggcggtcgcctggatgtactggaaggccattcagcgcagaataccctggtggatgacggcggtaccctggcagtgtctgccggtggtaaggcaacagatgtcaccatgacatccggtggtgccctgatagcagacagtggtgccactgttgaggggaccaatgccagcggtaagttcagtattgatggcatatccggtcaggccagcggcctgctgctggaaaatggcggcagctttacggttaatgccgggggacaggctggcaacaccactgtcggacatcgtggaacactgactctggctgccgggggaagtctgagtggcagaacacagctcagtaaaggcgccagtatggtactgaatggtgatgtggtcagtaccggcgatattgttaacgcaggggagattcgctttgataatcagacgacacaggatgccgtcctgagccgtgctgttgcaaaaggcgactccccggtaacgttccataaactgaccaccaataacctcaccggtcagggtggcaccatcaatatgcgtgttcgccttgatggcagcaatgcctctgaccagttggtgattaatggtggtcaggcaaccggcaaaacctggcttgcgtttacaaatgtcggaaacagtaacctcggggtggcaacctccggacagggtatccgggttgtggatgcacagaatggtgccaccacagaagaaggtgcgtttgccctgagtcgcccgcttcaggccggcgcctttaactacaccctgaaccgtgacagcgatgaagactggtacctgcgcagtgaaaatgcttatcgtgctgaagtccccctgtatgcctccatgctgacacaggcaatggactatgaccggattctggcaggctcccgcagccatcagaccggtgtaaacggtgaaaataacagcgtccgtctcagcattcagggcggtcatctcggtcacgataacaacggcggtattgcccgtggggccacgccggaaagcagcggcagctatggcctcgtccgtctggagggtgacctgctcagaacagaggttgccggtatgtctctgacgacaggggtgtatggtgccgcaggccattcttccgttgatgttaaggatgatgacggttcccgcgccggcacggtccgggatgatgccggcagcctgggcggatacctgaatctgacacacacgtcctccggcctgtgggctgacattgtggcacagggaacccgccacagcatgaaagcgtcatcggacaataacgacttccgcgcccggggctggggctggctgggctcactggaaactggtctgcccttcagtatcactgacaacctgatgctggagccacaactgcagtatacctggcagggactttccctggatgacggccaggataacgccggttatgtgaaattcgggcatggcagtgcacaacatgtacgtgccggtttccgtctgggcagccacaacgatatgacctttggtgaaggcacctcatcccgtgacaccctgcgcgacagtgcaaaacacagtgtgagtgaactgccggtgaactggtgggtacagccttctgttatccgcaccgtcagctcccggggtgacatgagcatgggtacagccgccgccggcagtaacatgacgttctcaccgtcccggaatggcacgtcactggacctgcaggccggactggaagcccgtgtccgggaaaatatcaccctgggcgttcaggccggttatgcccacagcgtcagcggcagcagcgctgaaggttataacggtcaggccacgctgaatatgactttc

SEQ ID NO: 126 - DNA, 2844 bp, Escherichia coli
atgaaacgacatctgaacaccagctacaggctggtatggaatcacattacgggcaccctggtggtggcttccgaactggcgcgctcacggggaaaacgcaccggtgtggcggttgcgctgtctcttgctgctgtcacgtcagtcccggtactggctgctgacacggtcgtacaggcgggagaaaccgtgagcggcggaacactgacaaatcatgacaaccagattgttctcggtacggccaacggaatgaccatcagtaccggtctggagtatgggccggataacgaggccaataccggcgggcaatggatacaaaatggcggtatcgccaacaacactactgtcaccggtggtggtcttcagagagtgaatgccggaggaagcgtttcagacacggttatcagtgccggaggcggacagagccttcaggggcaggcagtgaataccactctgaacggcggtgagcagtgggtacatgaaggcgggattgcaacgggtaccgtcattaatgagaagggctggcaggccgtcaaatccggcgcaatggcaaccgacacggttgtgaataccggcgcggaagggggaccagatgcagaaaatggtgataccgggcagtttgttcgcggaaatgccgtacgcaccaccatcaataaaaatggtcgtcagattgtggctgctgaaggaacggcaaataccactgtggtttatgccggcggcgaccagactgtacatggtcacgcactggataccacgctgaatggggggtaccagtatgtgcacaacggcggtacggcgtctggcactgttgtaaacagtgacggctggcagattatcaaggaaggtggtctggcggatttcaccaccgttaaccagaaaggcaaactgcaggtgaacgccggtggtaccgccacacatgtcaccctgaaacagggtggagcactggttaccagtactgcggcaacggttcttggcagcaaccgtctgggcaatttcacggtggaaaacggtaaggctgacggcgttgttctggagtccggcggtcgcctggatgtactggaaggccattcagcgcagaaaacacgggtggatgacggcggaaccctggcagtgtctgccggtggtaaggcaacagatgtcaccatgacatccggtagtgccctgattgcagacagtggtgccactgttgaggggaccaatgccagcggtaagttcagtattgatggcacatccggtcaggccagcggactgctgctggaaaatggcggcagctttacggttaatgccggaggactggccagcaacaccactgtcggacatcgtggaacactgacgctggctgccgggggaagtctgagtggcagaacacagctcagtaaaggtgccagcatggtactgaatggcgatgtggtcagtaccggcgatattgttaacgcaggggagattcgctttgataatcagacaacacaggatgccgtgctgagccgtgctgttgcaaaaggcgactccccggtaacgttccataaactgaccaccagtaacctcaccggtcagggtggcaccatcaatatgcgtgttcgccttgatggcagcaatacctctgaccagctggtgattaatggtggtcaggcaaccggcaaaacctggcttgcgtttacaaatgtcggaaacagtaacctcggggtggcaacctccggacagggtatccgggttgtggatgcacagaatggcgccaccacagaagaaggtgcgtttgccctgagtcgcccgcttcaggccggtgcctttaactacaccctgaaccgtgacagcgatgaagactggtatctgcgcagtgaaaatgcttatcgtgcagaagtccccctgtatgcctccatgctgacacaggcaatggactatgaccggattctggcaggctcccgcagccatcagaccggtgtaaacggtgaaaataacagcgtccgtctcagcattcagggcggtcatctcgggcacgataacaacggtggtattgcccgtggggccacgccggaaagcaacggcagctatggcttcgtccgtctggagggtgacctgctcagaacagaggttgccggtatgtcactgacgacaggagtgtatggtgctgcaggccattcttccgttgatgttaaggatgatgacggctcccgcgccggcacggtccgggatgatgccggcagcctgggcggatacctgaatctgacacacacgtcctccggcctgtgggctgacattgtggcacagggaacccgccacagcatgaaagcgtcatcggacaataacgacttccgcgcccggggctggggttggctgggctcactggaaaccggtctgcctttcagtatcactgacaacgtgatgctggagccacaactgcagtacacctggcaggggctctccctggatgacggccaggataacgccggttatgtgaagttcgggcatggcagtgcacaacatgtgcgtgccggtttccgtctgggcagccacaacgatatgagctttggtgaaggcacctcatcccgtgacaccctgcgcgacagtgcaaaacaccgtgtgcgtgaactgccggtgaactggtgggtacagccttctgttatccgcaccttcagttcccggggtgacatgagcatgggtacagccgccgccggcagtaacatgacgttctcaccgtcccggaatggcacgtcactggacctgcaggccggactggaagcccgtgtccgggaaaatatcaccctgggcgttcaggccggttatgcccacagcgtcagcggcagcagcgctgaaggttataacggtcaggccacgctgaatgtgactttc

SEQ ID NO: 127 - DNA, 2844 bp, Escherichia coli
atgaaacgacatctgaacaccagctacaggctggtatggaatcacattacgggcaccctggtggtggcttccgaactggcgcgctcacggggaaaacgcaccggtgtggcggttgcgctgtctcttgctgctgtcacgtcagtcccggtactggctgctgacacggtcgtacaggcgggagaaaccgtgagcggcggaacactgacaaatcatgacaaccagattgttctcggtacggccaacggaatgaccatcagtaccggtctggagtatgggccggataacgaggccaataccggcgggcaatggatacaaaatggcggtatcgccaacaacactactgtcaccggtggtggtcttcagagagtgaatgccggaggaagcgtttcagacacggttatcagtgccggaggcggacagagccttcaggggcaggcagtgaataccactctgaacggcggtgagcagtgggtacatgaaggcgggattgcaacgggtaccgtcattaatgagaagggctggcaggccgtcaaatccggcgcaatggcaaccgacacggttgtgaataccggcgcggaagggggaccagatgcagaaaatggtgataccgggcagtttgttcgcggaaatgccgtacgcaccaccatcaataaaaatggtcgtcagattgtggctgctgaaggaacggcaaataccactgtggtttatgccggcggcgaccagactgtacatggtcacgcactggataccacgctgaatggggggtaccagtatgtgcacaacggcggtacggcgtctggcactgttgtaaacagtgacggctggcagattatcaaggaaggtggtctggcggatttcaccaccgttaaccagaaaggcaaactgcaggtgaacgccggtggtaccgccacacatgtcaccctgaaacagggtggagcactggttaccagtactgcggcaacggttcttggcagcaaccgtctgggcaatttcacggtggaaaacggtaaggctgacggcgttgttctggagtccggcggtcgcctggatgtactggaaggccattcagcgcagaaaacacgggtggatgacggcggaaccctggcagtgtctgccggtggtaaggcaacagatgtcaccatgacatccggtagtgccctgattgcagacagtggtgccactgttgaggggaccaatgccagcggtaagttcagtattgatggcacatccggtcaggccagcggactgctgctggaaaatggcggcagctttacggttaatgccggaggactggccagcaacaccactgtcggacatcgtggaacactgacgctggctgccgggggaagtctgagtggcagaacacagctcagtaaaggtgccagcatggtactgaatggcgatgtggtcagtaccggcgatattgttaacgcaggggagattcgctttgataatcagacaacacaggatgccgtgctgagccgtgctgttgcaaaaggcgactccccggtaacgttccataaactgaccaccagtaacctcaccggtcagggtggcaccatcaatatgcgtgttcgccttgatggcagcaatacctctgaccagctggtgattaatggtggtcaggcaaccggcaaaacctggcttgcgtttacaaatgtcggaaacagtaacctcggggtggcaacctccggacagggtatccgggttgtggatgcacagaatggcgccaccacagaagaaggtgcgtttgccctgagtcgcccgcttcaggccggtgcctttaactacaccctgaaccgtgacagcgatgaagactggtatctgcgcagtgaaaatgcttatcgtgcagaagtccccctgtatgcctccatgctgacacaggcaatggactatgaccggattctggcaggctcccgcagccatcagaccggtgtaaacggtgaaaataacagcgtccgtctcagcattcagggcggtcatctcgggcacgataacaacggtggtattgcccgtggggccacgccggaaagcaacggcagctatggcttcgtccgtctggagggtgacctgctcagaacagaggttgccggtatgtcactgacgacaggagtgtatggtgctgcaggccattcttccgttgatgttaaggatgatgacggctcccgcgccggcacggtccgggatgatgccggcagcctgggcggatacctgaatctgacacacacgtcctccggcctgtgggctgacattgtggcacagggaacccgccacagcatgaaagcgtcatcggacaataacgacttccgcgcccggggctggggttggctgggctcactggaaaccggtctgcccttcagtatcactgacaacctgatgctggagccacaactgcagtacacctggcaggggctctccctggatgacggccaggataacgccggttatgtgaagttcgggcatggcagtgcacaacatgtgcgtgccggtttccgtctgggcagccacaacgatatgagctttggtgaaggcacctcatcccgtgacaccctgcgcgacagtgcaaaacaccgtgtgcgtgaactgccggtgaactggtgggtacagccttctgttatccgcaccttcagttcccggggtgacatgagcatgggtacagccgccgccggcagtaacatgacgttctcaccgtcccggaatggcacgtcactggacctgcaggccggactggaagcccgtgtccgggaaaatatcaccctgggcgttcaggccggttatgcccacagcgtcagcggcagcagcgctgaaggttataacggtcaggccacgctgaatgtgactttc

SEQ ID NO: 128 - DNA, 3117 bp, Escherichia coli
atgaaacgacatctgaacaccagctacaggctggtatggaatcacattacgggcaccctggtggtggcctccgaactggcccgctcacggggaaaacgcgctggtgtggcggttgcgctgtctcttgctgctgtcacatcagtcccggcactggctgctgacaaggttgtacaggcgggagaaaccgtgaacgacggaacactgacaaatcatgacaaccagattgtcctcggtacggccaacggaatgaccatcagtaccggtctggagtatgggccggataacgaggccaataccggcggacaatggatacaaaatggcggtatcgccaacaacactactgtcaccggtggtggtcttcagagagtgaatgccggaggaagcgtttcagacacggttatcagtgccggaggcggacagagccttcaggggcaggcagtgaacaccactctgaacggcggtgagcagtgggtacatgaaggcgggattgcaacgggtaccgtcattaatgagaagggctggcaggccatcaaatccggcgcagtggcaaccgacacggttgtgaataccggcgcggaagggggaccggatgcggaaaatggtgataccgggcagaccgtctacggagatgccgtacgcaccaccatcaataaaaatggtcgtcagattgtggctgctgaaggaacggcaaataccactgtggtttatgccggcggcgaccagactgtacatggtcacgcactggataccacgctgaatggggggtaccagtatgtgcacaacggcggtacggcgtctggcactgttgtaaacagtgacggctggcagattgtcaaaaacgggggtgtggccgggaataccaccgttaatcagaagggcagactgcaggtggacgccggtggtacagccacgaatgtcaccctgaagcagggcggcgcactggttaccagtacggctgcaaccgttaccggcataaaccgcctgggagcattctctgttgtggagggtaaagctgataatgtcgtactggaaaatggcggacgcctggatgtgctgaccggacacacagccactaatacccgcgtggatgatggcggaacgctggatgtccgcaacggtggcaccgccaccaccgtatccatgggaaatggcggtgtactgctggccgattccggtgccgctgtcagtggtacccggagcgacggaaaggcattcagtatcggaggtggtcaggcggatgccctgatgctggaaaaaggcagttcattcacgctgaacgccggtgatacggccacggataccacggtaaatggcggactgttcaccgccaggggcggcacactggcgggcaccaccacgctgaataacggcgccatacttaccctttccgggaagacggtgaacaacgataccctgaccatccgtgaaggcgatgcactcctgcagggaggctctctcaccggtaacggcagcgtggaaaaatcaggaagtggcacactcactgtcagcaacaccacactcacccagaaagccgtcaacctgaatgaaggcacgctgacgctgaacgacagtaccgtcaccacggatgtcattgctcagcgcggtacagccctgaagctgaccggcagcactgtgctgaacggtgccattgaccccacgaatgtcactctcgcctctggtgccacctggaatattcccgataacgccacggtgcagtcggtggtggatgacctcagccatgccggacagattcatttcacctccacccgcacagggaagttcgtaccggcaaccctgaaagtgaaaaacctgaacggacagaatggcaccatcagcctgcgtgtacgcccggatatggcacagaacaatgctgacagactggtcattgacggtggcagggcaaccggaaaaaccatcctgaacctggtgaacgccggcaacagtgcgtcggggctggcgaccagcggtaagggtattcaggtggtggaagccattaacggtgccaccacggaggaaggggcctttatccaggggaataagctgcaggccggtgcctttaactactccctcaaccgggacagtgatgagagctggtatctgcgcagtgaaaatgcttatcgtgcagaagtccccctgtatgcctccatgctgacacaggcaatggactatgaccggattctggcaggctcccgcagccatcagaccggtgtaagcggtgaaaataacagcgtccgtctcagcattcagggcggtcatctcggtcacgataacaacggcggtattgcccgtggagccacgccggaaagcagcggcagctatggcttcgtccgtctggagggtgacctgctcagaacagaggttgccggtatgtctgtgaccgcgggggtatatggtgctgctggccattcttccgttgatgttaaggatgatgacggctcccgtgccggcacggtccgggatgatgccggcagcctgggcggatacctgaatctgatacacaacgcctccggcctgtgggctgacattgtggcccagggaacccgccacagcatgaaagcctcatcggacaataacgacttccgcgtccggggctggggctggctgggttcgctggaaaccggtctgcccttcagtatcactgacaatctgatgctggagccgcaactgcagtacacctggcagggactctccctggatgacggccaggataacgccagttatgtgaagttcgggcatggcagtgcacaacatgtgcgtgccggcttccgtctgggcagccaccacgatatgaactttggtaaaggcacctcatcccgtgacaccctgcgcggcagtgccaaacacagtgtgcgtgaactgccggtgaactggtgggtacagccttctgttatccgcaccttcagctcccggggggacatgagcatgggtacagccgcagccggcagtaacatgacgttctcaccgtcacagaatggtacgtcactggacctgcaggccggactggaagcccgtgtccgggaaaatatcaccctgggcgttcaggcaggttatgtccacagcgtcagcggcagcagcgctgaaggctataacggtcaggccacgctgaatgtgaccttc

SEQ ID NO: 129 - DNA, 3117 bp, Escherichia coli
atgaaacgacatctgaataccagctacaggctggtatggaatcacattacaggcgctttcgtggttgcctccgaactggcccgtgcacgggggaaacgcgccggtgtggcggttgcactgtctcttgccgctgccacgtcactcccggcgctggctgctgactctgttgtaccggcaggagaaaccgtgaacggtggaacgctgataaatcacgaccgccagtttgtctcaggtacggctgatggaatgactgtcagcaccggactggagctgggggcggactctgataacaacaccggcggtcagcagatagcccggggtggaacagccagaaacaccagagtcaccgcaaacggtctacaggatgtcatggcaggtggcagtacctcggatacggttatcagtaccgggggagggcagaatttgcgtgggaaggcttccggtactgtccttaacggcggtgatcaatggatacatgcaggcggcagggcatccggaacggtgattaaccaggatggttaccagaccattaaacatggcggactggtaaccggaaccatcgtcaacaccggtgcagaaggtggtccggattctgaaaatgtgtccaccggtcagatggtcggggggattgctgaatccaccaccataaacaaaaatggccggcaggttatctggtcttcggggatagcccgggacactctcatttacacaggaggtgaccagacggtacacggagaggcacataacacccgactggagggagggaaccagtatgtgcacaagtatggacttgcactgaacacggtaattaacgaggggggctggcaggttgttaaggccggtggtactgccggtaacaccaccataaatcagaacggcgagctgagggttcatgccggcggtgaagcgtctgatgtcacccagaacacgggaggtgcactggttaccagcactgctgcaactgtcaccggtacaaaccgcctgggagcattctctgttgtggagggtaaagctgataatgtcgtactggaaaatggcggacgtctggatgtgctgagcggacacacagccaccagaacccttgtggatgatggcggaacgctggatgtccgcaacggtggtaccgccactgccgtatccatgggaaatggcggggtactgctggccgattccggggccgctgtcagtggtacccggagcgacggaacggcattccgtatcgggggcggtcaggcggatgccctgatgctggaaaaaggcagttcattcacgctgaacgccggtgatacggccacggataccacggtaaatggcggactgttcactgccagagggggctcgctggcgggcaccaccacgctgaataacggtgccacgtttacccttgccgggaagacggtgaacaacgataccctgaccatccgtgaaggtgatgcactcctgcagggaggcgctctcaccggtaacggcagggtggaaaaatcaggaagtggcacactcactgtcagcaacaccacactcacccagaaagccgtcaacctgaatgaaggcacgctgacgctgaacgacagtaccgtcaccacggatatcatcgctcatcgcggcacggccctgaagctgaccggcagcacagtgctgaacggtgccattgaccccacgaatgtcaccctgacatccggtgccacctggaatatccccgataacgccacggttcagtcggtggtggatgacctcagccatgccggacagattcatttcacctccgcccgcacagggaagttcgttccgacaactctgcaggtgaaaaacctgaacgggcagaatggcaccatcagcctgcgtgtacgcccggatatggcgcagaacaatgctgacagactggtcattgacggtggcagagcaaccggaaaaaccatcctgaatctggtgaacgccggcaacagtggtacgggtctggcgaccaccggtaagggtattcaggtggttgaggccattaacggtgccaccacggaggaaggggcttttgtccaggggaatatgctgcaggccggggcctttaactacaccctcaaccgggacagtgatgagagctggtatctgcgcagtgaagaacgttatcgtgctgaagtccccctgtacgcctccatgctgacacaggcaatggactatgaccggattctggcaggctcccgcagccatcagaccggtgtaaacggtgaaaataacagcgtccgtctcagcattcagggcggccatctcggtcacgataacaacggcggtattgcccgtggggccacgccggaaagcagcggcagctatggcttcgtccgtctggagggtgacctgctcagaacagaggtcgccggtatgtcactgacgacaggagtgtatggtgctgcaggccattcttccgttgatgttaaggatgatgacggctcccgcgccggcacggtccgggatgatgccggcagcctgggcggatatatgaacctgacacacacctcctccggcctgtgggctgacattgtggcacagggaacccgccacagcatgaaagcgtcatcggacaataacgacttccgcgcacggggccggggctggctgggctcactggaaaccggtctgcccttcagtatcactgacaacctgatgctggagccacggctgcagtacacctggcaggggctttcgctggatgacggtaaggacaacgccggttatgtgaagttcgggcatggcagtgcacagcatgtgcgtgccggtttccgtctgggcagccacaacgatatgacctttggtgaaggcacctcatcccgtgcccccctgcgtgacagtgcaaaacacagtgtgcgtgaactgccggtgaactggtgggtacagccttccgttatccgcaccttcagctcccggggtgatatgcgtgtggggacctccaccgcaggcagcgggatgacgttctctccctcacagaatggcacttcactggatctgcaggccggactggaagcccgtgtccgggaaaatatcaccctgggcgttcaggccggttatgcccacagcatcaacggcagcagcgctgaaggttataacagtcaggccacactgaatgtgaccttc

SEQ ID NO: 130 - DNA, 3120 bp, Escherichia coli
atgaaacgacatctgaatacctgctacaggctggtatggaatcacattacgggcgctttcgtggttgcctccgaactggcccgcgcacggggtaaacgtggcggtgtggcggttgcactgtctcttgccgcggtcacgccactcccggtgctgtctgctgacatcgttgtgcacccgggtgaaacagtgaatggcggaacactggtaaaccatgacaaccagtttgtatccggaacagctaatggcgtgactgtcagtaccgggcttgagctggggccggacagtgacgaaaacaccggcgggcaatggataaaagcgggtggcacaggcagaaacaccactgtcaccgcaaatggtcgtcagattgtgcaggcaggaggaactgccagtgatacggttattcgtgatggcggagggcagagccttaacggactggcggtgaacaccacgctggataacagaggtgagcagtgggtacacgggggagggaaagctgccggtacaattattaaccaggatggttaccagaccataaaacatggcggactggcaaccggaaccatcgtcaacaccggtgcagaaggtggtccggagtctgaaaatgtgtccagcggtcagatggtcggagggacggctgaatccaccaccatcaataaaaatggccggcaggttatctggtcttcggggatggcacgggacaccctcatttacgccggtggtgaccagacggtacacggagaggcacataacacccgactggaggggggtaaccagtatgtacacaacggtggcacggcaacagagacgctgataaaccgtgatggctggcaggtgattaaggaaggaggaactgccgcgcataccaccatcaaccagaaaggaaagctgcaggtgaatgccggcggtaaagcgtctgatgtcacccagaacacgggcggtgcactggttaccagtacagctgcaaccgtcaccggcacaaaccgcctgggagcattctccgttgtggcgggtaaggctgataatgtcgtactggaaaatggcggacgtctggatgtgctgagcggacacacagccactaatacccgtgtggatgatggcggaacgctggatatccgcaacggtggtgccgccaccaccgtatccatggggaatggcggtgtactgctggccgattccggtgccgctgtcagtggtacccggagcgacggaaaggcattcagtatcggaggcggtcaggcggatgccctgatgctggaaaaaggcagttcattcacgctgaacgccggtgatacggccacggataccacggtaaatggcggactgttcaccgccaggggcggcacactggcgggcaccaccacgctgaataacggcgccatacttaccctttccgggaagacggtgaacaacgataccctgaccatccgtgaaggcgatgcactcctgcagggaggctctctcaccggtaacggcagcgtggaaaaatcaggaagtggcacactcactgtcagcaacaccacactcacccagaaagccgtcaacctgaatgaaggcacgctgacgctgaacgacagtaccgtcaccacggatgtcattgctcagcgcggtacagccctgaagctgaccggcagcactgtgctgaacggtgccattgaccccacgaatgtcactctcgcctccgatgccacctggaatatccccgataacgccacggtgcagtcggtggtggatgacctcagccatgccggacagattcatttcacctcctcacgcacagggacatttgtgccggcgactctgaaagtgaaaaacctgaacgggcagaatggcaccatcagcctgcgtgtacgcccggatatggcacagaacaatgctgacagactggtcattgacggcggcagggcaaccggaaaaaccatcctgaacctggtgaacgccggcaacagtgcgtcggggctggcgaccagcggtaagggtattcaggtggtggaagccattaacggtgccaccacggaggaaggggcctttgtccaggggaacaggctgcaggccggggcctttaactactccctcaaccgggacagtgatgagagctggtatctgcgcagtgaaaatgcttatcgtgcagaagtccccctgtatgcctccatgctgacacaggcaatggactatgaccggattctggcaggctcacgcagccatcagaccggtgtaaacggtgaaaataacagcgtccgtctcagcattcagggcggccatctcggtcacgataacaacggcggtattgcccgtggggccacgccggaaagcagcggcagctatggcttcgtccgcctggagggtgacctgctgagaacagatgttgccggtatgtctgtgaccgcagggatatatggtgctgcaggccattcttccgttgatgttaaggatgatgacggctcccgtgccggcacggtccgggatgatgccggcagcctgggcggatatatgaacctgacacacacctcctccggcctgtgggctgacatagtggcacagggaacccgccacagtatgaaagcgtcatcgggcaataacgacttccgcgcacggggccggggctggctgggctcactggaaaccggtctgcccttcagtatcactgacaacctgatgctggagccacggctgcagtacacctggcaggggctttcgctggatgacggtaaggacaacgccggttatgtgaagttcgggcatggcagtgcacaacatgtgcgtgccggtttccgtctgggcagccacaacgatatgacctttggtgaaggcacctcatcccgtgcccccctgcgtgacagtgcaaaacacagtgtgcgtgaactgccggtgaactggtgggtacagccttccgttatccgcaccttcagctcccggggtgatatgcgtgtggggacctccactgcaggcagcgggatgacgttctctccctcacagaatggcacatcactggacctgcaggccggactggaagcccgtgtccgggaaaatatcaccctgggcgttcaggccggttatgcccacagcgtcagcggcagcagcgctgaagggtataacggtcaggccacactgaatgtgaccttc

SEQ ID NO: 131 - DNA, 3117 bp, Escherichia coli
atgaaacgacatctgaatacctgctacaggctggtatggaatcacatgacgggcgctttcgtggttgcctccgaactggcccgcgcacggggtaaacgtggcggtgtggcggttgcactgtctcttgccgcagtcacgtcactcccggtgctggctgctgacatcgttgtgcacccgggagaaaccgtgaacggcggaacactggcaaatcatgacaaccagattgtcttcggtacgaccaacggaatgaccatcagtaccgggctggagtatgggccggataacgaggccaataccggcgggcaatgggtacaggatggcggaacagccaacaaaacgactgtcaccagtggtggtcttcagagagtgaaccccggtggaagtgtctcagacacggttatcagtgccggaggcggacagagccttcagggacgggctgtgaacaccacgctgaatggtggcgaacagtggatgcatgagggggcgatagccacaggaaccgtcattaatgataagggctggcaggtcgtcaagcccggtacagtggcaacggataccgttgttaataccggggcggaagggggaccggatgcagaaaacggtgataccgggcagtttgttcgcggggatgccgtacgcacaaccatcaataaaaacggtcgccagattgtgagagctgaaggaacggcaaataccactgtggtttatgccggcggcgaccagactgtacatggtcacgcactggataccacgctgaatgggggataccagtatgtgcacaacggcggtacagcgtctgacactgttgtgaacagtgacggctggcagattgtcaaaaacgggggtgtggccgggaataccaccgttaatcagaagggcagactgcaggtggacgccggtggtacagccacgaatgtcaccctgaagcagggcggcgcactggttaccagtacggctgcaaccgttaccggcataaaccgcctgggagcattctctgttgtggagggtaaagctgataatgtcgtactggaaaatggcggacgcctggatgtgctgaccggacacacagccactaatacccgcgtggatgatggcggaacgctggatgtccgcaacggtggcaccgccaccaccgtatccatgggaaatggcggtgtactgctggccgattccggtgccgctgtcagtggtacccggagcgacggaaaggcattcagtatcggaggcggtcaggcggatgccctgatgctggaaaaaggcagttcattcacgctgaacgccggtgatacggccacggataccacggtaaatggcggactgttcaccgccaggggcggcacactggcgggcaccaccacgctgaataacggcgccatacttaccctttccgggaagacggtgaacaacgataccctgaccatccgtgaaggcgatgcactcctgcagggaggctctctcaccggtaacggcagcgtggaaaaatcaggaagtggcacactcactgtcagcaacaccacactcacccagaaagccgtcaacctgaatgaaggcacgctgacgctgaacgacagtaccgtcaccacggatgtcattgctcagcgcggtacagccctgaagctgaccggcagcactgtgctgaacggtgccattgaccccacgaatgtcactctcgcctccggtgccacctggaatatccccgataacgccacggtgcagtcggtggtggatgacctcagccatgccggacagattcatttcacctccacccgcacagggaagttcgtaccggcaaccctgaaagtgaaaaacctgaacggacagaatggcaccatcagcctgcgtgtacgcccggatatggcacagaacaatgctgacagactggtcattgacggcggcagggcaaccggaaaaaccatcctgaacctggtgaacgccggcaacagtgcgtcggggctggcgaccagcggtaagggtattcaggtggtggaagccattaacggtgccaccacggaggaaggggcctttgtccaggggaacaggctgcaggccggtgcctttaactactccctcaaccgggacagtgatgagagctggtatctgcgcagtgaaaatgcttatcgtgcagaagtccccctgtatgcctccatgctgacacaggcaatggactatgaccggattgtggcaggctcccgcagccatcagaccggtgtaaatggtgaaaacaacagcgtccgtctcagcattcagggcggtcatctcggtcacgataacaatggcggtattgcccgtggggccacgccggaaagcagcggcagctatggattcgtccgtctggagggtgacctgatgagaacagaggttgccggtatgtctgtgaccgcgggggtatatggtgctgctggccattcttccgttgatgttaaggatgatgacggctcccgtgccggcacggtccgggatgatgccggcagcctgggcggatacctgaatctggtacacacgtcctccggcctgtgggctgacattgtggcacagggaacccgccacagcatgaaagcgtcatcggacaataacgacttccgcgcccggggctggggctggctgggctcactggaaaccggtctgcccttcagtatcactgacaacctgatgctggagccacaactgcagtatacctggcagggactttccctggatgacggtaaggacaacgccggttatgtgaagttcgggcatggcagtgcacaacatgtgcgtgccggtttccgtctgggcagccacaacgatatgacctttggcgaaggcacctcatcccgtgcccccctgcgtgacagtgcaaaacacagtgtgagtgaattaccggtgaactggtgggtacagccttctgttatccgcaccttcagctcccggggagatatgcgtgtggggacttccactgcaggcagcgggatgacgttctctccctcacagaatggcacatcactggacctgcaggccggactggaagcccgtgtccgggaaaatatcaccctgggcgttcaggccggttatgcccacagcgtcagcggcagcagcgctgaagggtataacggtcaggccacactgaatgtgaccttc

SEQ ID NO: 132 - DNA, 2844 bp, Escherichia coli
atgaaacgacatctgaacaccagctacaggctggtatggaatcacattacgggcaccctggtggtggcttccgaactggcgcgctcacggggaaaacgcaccggtgtggcggttgcgctgtctcttgctgctgtcacgtcagtcccggtactggctgctgacacggtcgtacaggcgggagaaaccgtgagcggcggaacactgacaaatcatgacaaccagattgtcttcggtacggccaacggaatgaccatcagtaccggtctggagtatgggccggataacgaggccaataccggcggacaatggatacaaaatggcggtatcgccaacaacactactgtcaccggtggtggtcttcagagagtgaatgctggaggaagcgtttcagacacggttatcagtgccggaggcggacagagccttcaggggcaggcagtgaacaccactctgaacggcggtgagcagtgggtacatgaaggcgggattgcaacggttaccgtcattaatgagaagggctggcaggccgtcaaatccggcgcaatggcaaccgacacggttgtgaataccggcgcggaagggggaccagatgcagacaatggtgataccgggcagtttgttcgcggaaatgccgtacgtaccaccatcaataaaaatggtcgtcagattgtggctgttgaaggaacagcaaataccactgtggtttatgccggcggcgaccagacggtacacgggcatgcgctggataccacactgaatggcggttaccagtatgtgcacaacggaggcacagcctctgacacggttgtaaacagtgacggctggcagattgtcaaggaaggtggtctggcggatttcaccaccgttaaccagaaaggcaaactgcaggtgaacgccggtggtacagccacgaatgtcaccctgaagcagggaggcgcactggtcaccagtacggcggcaaccgtcaccggcagcaaccgtctgggcaatttcactgtggaaaacggtaatgctgacggtgttgttctggagtccggtggtcgcctggatgtactggagggccattcagcctggaaaacacgggtggatgacggcggaaccctggcagtgtctgccggtggtaaggcaacaggtgtcaccatgacatccggtggtgccctgattgcagacagtggtgccactgttgaggggaccaatgccagcggtaagttcagtattgatggcatatccggtcaggccagcggcctgctgctggaaaatggcggcagctttacggttaatgccgggggacaggccagcaacaccactgtcggacatcgtggaacactgatgctggctgccgggggaagtctgagtggcagaacacagctcagtaaaggcgccagcatggtactgaatggtgatgtggtcagtaccggcgatattgttaacgcaggggagatttactttgacaatcagacaacaccggatgccgtactgagccgtgctgttgcaaaaggcaacgccccggtaacgttccataaactgacaaccagtaacctcaccggtcagggtggcaccatcaatatgcgtgttcgccttgatggcagcaatgcctctgaccagctggtgattaatggtggtcaggcaaccggcaaaacctggcttgcgtttacaaatgtcggaaacagcaacctcggggtggcaaccaccggacagggtatccgggttgtggatgcacagaatggcgccaccacagaagaaggtgtgtttgccctgagtcgcccgcttcaggccggcgcctttaactacaccctgaaccgtgacagcgatgaagactggtacctgcgcagtgaaaatgcttatcgtgctgaagtccccctgtatacatccatgctgacacaggcaatggactatgaccggattctggcaggctcccgcagccatcagaccggtgtaaacggtgaaaataacagcgtccgtctcagcattcagggcggtcatctcggtcacgataacaacggcggtattgcccgtggagccacgccggaaagcagcggcagctatggcttcgtccgtctggagggtgacctgctcagaacagaggttgccggtatgtctctgacgacaggggtgtatggtgctgcaggccattcttccgttgatgttaaggatgatgacggttcccgcgccggcacggtccgggatgatgccggcagtctgggcggatacctgaatctggtacacacatcctccggcctgtgggctgacattgtggcccagggaacccgccacagcatgaaagcgtcatcggacaataacgacttccgcgcccggggctggggctggctgggctcactggaaaccggtctgcccttcagtatcactgacaacctgatgctggagccacaactgcagtatacctggcagggactttccctggatgacggccaggataacgccggttatgtgaagttcgggcatggcagtacacaacatgtgcgtgccggcttccgtctgggcagccacaacgatatgacctttggcgaaggcacctcatcccgtgacaccctgcgcgacagtgcaaaacaccgtgtgcgtgaactgccggtgaactggtgggtacagccttctgttatccgcaccttcagttcccggggtgacatgagcatggggacagccgccgccggcagtaacatgacgttctcaccgtcccggaatggcacgtcactggacctgcaggccggactggaagcccgtgtccgggaaaatatcaccctgggcgttcaggccggttatgcccacagcgtcagcggcagcagcgctgaaggttataacggtcaggccacgctgaatgtgactttc

SEQ ID NO: 133 - DNA, 2847 bp, Escherichia coli
atgaaacgacatctgaacaccagctacaggctggtatggaatcacattacgggcaccctggtggtggcctccgaactggcccgctcacggggaaaacgcgccggtgtggcggttgcgctgtctcttgctgctgtcacatcagtcccggcactggctgctgacaaggttgtacaggcgggagaaaccgtgaacgatggaacactgacaaatcatgacaaccagattgtcttcggtacggccaacggaatgaccatcagtaccgggctggaactggggccggacagtgaagaaaacaccggtgggcaatggatacagaatggcgggatagccggaaacaccactgtcaccacaaatggtcgtcaggtcgtgctggaggggggaacagccagtgatacggttattcgtgacggcgggggacagagcctgaacggactggcggtgaacaccacactgaataacagaggcgagcagtgggtgcatgagggcggggttgccaccggtacaattatcaaccgcgacggttaccagagcgttaaaagtggcgggctggcaacaggaaccatcatcaacaccggcgcagaaggcggccctgattctgacaactcgtatacgggtcagaaggtccagggaacagcagaatccaccaccatcaacaaaaatggacggcagattatcttattttccgggctagcccgtgacactctcatttacgcaggtggtgaccagtcggtacacggaagggccctgaataccacactgaatggcggttaccagtatgtgcacagggacggacttgcgctgaacacggtaattaacgaggggggctggcaggttgttaaggcaggtggcgctgccggtaacaccaccataaatcagaacggtgaactgagggtacatgccggcggggaagccactgcagtcacccagaacacgggcggtgcactggttaccagtactgctgcaactgtcatcggcacaaaccgtctggggaatttcacggtggaaaacggtaaggctgacggtgttgttctggaatccggcggtcgtctggatgtactggagagccattcagcacagaataccctagtggatgacggcggtaccctggcagtgtctgccggcggtaaggcgacaagtgtcaccataacatccggtggtgccctgattgcagacagtggtgccactgttgaggggaccaatgccagcggtaagttcagtattgatggcacatccggtcaggccagcggcctgctgctggaaaatggcggcagctttacggttaatgccgggggacaggctggcaacaccactgtcggacatcgtggaacactgacgctggctgccgggggaagtctgagtggcagaacacagctcagtaaaggcgccagtatggtactgaatggtgatgtggtcagtaccggcgatattgttaacgcaggggagattcgctttgataatcagacgacaccgaatgccgcgctgagccgtgctgttgcaaaaagtaactccccggtaacgttccataaactgaccaccacgaacctcaccggccagggcggcaccatcaatatgcgtgttcgccttgatggcagcaatgcctctgaccagctggtgattaatggtggtcaggcaaccggcaaaacctggcttgcgtttacaaatgtcggaaacagcaacctcggggtggcaaccaccggacagggtatccgggttgtggatgcacagaatggcgccaccacagaagaaggtgcgtttgccctgagtcgcccgcttcaggccggcgcctttaactacaccctgaaccgtgacagcgatgaagactggtacctgcgcagtgaaaatgcttatcgtgctgaagtccccctgtatacatccatgttgacacaggcaatggactatgaccggattctggcaggctcccgcagccatcagaccggtgtaaacggtgaaaataacagcgtccgtctcagcattcagggcggtcatctcggtcacgataacaacggcggtattgcccgtggagccacgccggaaagcagcggcagctatggcttcgtccgtctggagggtgacctgctcagaacagaggttgccggtatgtctctgacgacaggggtgtatggtgctgcaggccattcttccgttgatgttaaggatgatgacggttcccgcgccggcacggtccgggatgatgccggcagtctgggcggatacctgaatctggtacacacatcctccggcctgtgggctgacattgtggcccagggaacccgtcacagcatgaaagcgtcatcggacaataacgacttccgcgcccggggctggggctggctgggctcactggaaaccggtctgcccttcagtatcactgacaatctgatgctggagccacaactgcagtacacctggcagggactctccctggatgacggccaggataacgccggttatgtgaagttcgggcatggcagtgcacaacatgtgcgtgccggtttccgtctgggcagccacaacgatatgacctttggtgaaggcacctcatcccgtgacaccctgcgcgacagtgcaaaacacagtgtgagtgaactgccggtgaactggtgggtacagccttctgttatccgcaccttcagctcccggggtgacatgagcatggggacagccgcagccggcagtaacatgacgttctcaccgtcccggaatggcacgtcactggacctgcaggccggactggaagcccgtatccgggaaaatatcaccctgggcgttcaggccggttatgcccacagcgtcagcggcagcagcgctgaaggctataacggtcaggctacgctgaatatgactttc

SEQ ID NO: 134 - DNA, 2844 bp, Escherichia coli
atgaaacgacatctgaacaccagctacaggctggtatggaatcacattacgggcaccctggtggtggcttccgaactggcccgctcacggggaaaacgcgccggtgtggcggttgcgctgtctcttgctgctgtcacatcagtcccggcactggctgctgacacggttgtacaggctggagaaaccgtgagcggcggaacactggtaaatcatgacaaccagattgtcttcggtacggccaacggaatgaccatcagtaccggtctggagtatgggccggataacgaggccaataccggcggacaatggatacaaaatggcggtaccgccaacaacactactgtcaccggtggtggtcttcagagagtgaataccggaggaagcgtttcagacacggttatcagtgccggaggcggacagagccttcaggggcaggcagtgaacaccactctgaacggcggtgagcagtgggtacatgaaggcgggattgcaacgggtaccgtcattaatgagaagggctggcaggccatcaaatccggcgcagtggcaaccgacacggttgtgaataccggcgcggaagggggaccggatgcggaaaatggtgataccgggcagaccgtctacggagatgccgtacgcaccaccatcaataaaaatggtcgtcagattgtggctgctgaaggaacggcaaataccactgtggtttatgccggcggcgaccagactgtacatggtcacgcactggataccacgctgaatggggggtaccagtatgtgcacaacggcggtacggcatctggcactgttgtaaacagtgacggctggcagattatcaaggaaggcggtctggcggatttcaccaccgttaaccagaaaggcaaactgcaggtgaacgccggtggtacagccacgaatgtcaccctgaagcagggcggcgcactggtcaccagtactgcagcaactgttcttggcagcaaccgtctggggaatttcacggtggaaaacggtaaggctgacggtgttgttctggagtccggtggtcgcctggatgtactggagggacattcagcctggaaaacactggtggatgacggcggtaccctggcagtgtctgccggtggtaaggcaacaggtgtcaccatgacatccggtggtgccctgattgcagacagtggtgccactgttgaggggaccaatgccagcggtaagttcagtattgatggcatatccggtcaggccagcggcctgctgctggaaaatggcggcagctttacggttaatgccgggggacaggccagcaacaccactgtcggacatcgtggaacactgatgctggctgccgggggaagtctgagtggcagaacacagctcagtaaaggcgccagcatggtactgaatggtgatgtggtcagtaccggcgatattgttaacgcaggggagatttactttgataatcagacaacaccggacgccgtactgagccgtgctgttgcaaaaggcaacgccccggtaacgttccataaactgacaaccagtaacctcaccggtcagggtggcaccatcaatatgcgtgttcgccttgatggcagcaatacctctgaccagctggtgattaatggtggtcaggcaaccggcaaaacctggcttgcgtttacaaatgtcggaaacagtaacctcggggtggcaacctccggacagggtatccgggttgtggatgcacagaatggtgccaccacagaagaaggtgcgtttgccctgagtcgcccgcttcaggccggcgcctttaactacaccctgaaccgtgacagcgatgaagactggtacctgcgcagtgaaaatgcttatcgtgctgaagtccccctgtatgcctccatgctgacacaggcaatggactatgaccggattctggcaggctcccgcagccatcagagcggtgtaagcggtgaaaataacagcgtccgtctcagcattcagggcggtcatctcgggcacgataacaacggtggtattgcccgtggggccacgccggaaagcaacggcagctatggcttcgtccgtctggagggtgacctgctcagaacagaggttgccggtatgtcactgacgacaggagtgtatggtgctgcaggccattcttccgttgatgttaaggatgatgacggctcccgcgccggcacggtccgggatgatgccggcagcctgggcggatacctgaatctgacacacacgtcctccggcctgtgggctgacattgtggcacagggaacccgccacagcatgaaagcgtcatcggacaataacgacttccgcgcccggggctggggttggctgggctcactggaaaccggtctgcccttcagtatcactgacaacctgatgctggagccacaactgcagtacacctggcaggggctctccctggatgacggccaggataacgccggttatgtgaagttcgggcatggcagtgcacaacatgtgcgtgccggtttccgtctgggcagccacaacgatatgagctttggtgaaggcacctcatcccgtgacaccctgcgcgacagtgcaaaacaccgtgtgcgtgaactgccggtgaactggtgggtacagccttctgttatccgcaccttcagttcccggggtgacatgagcatgggtacagccgccgccggcagtaacatgacgttctcaccgtcccggaatggcacgtcactggacctgcaggccggactggaagcccgtgtccgggaaaatatcaccctgggcgttcaggccggttatgcccacagcgtcagcggcagcagcgctgaaggttataacggtcaggccacgctgaatgtgactttc

SEQ ID NO: 135 - DNA, 2847 bp, Escherichia coli
atgaaacgacatctgaacaccagctacaggctggtatggaatcacattacgggcaccctggtggtggcttccgaactggcccgctcacggggaaaacgcgccggtgtggcggttgctctgtctcttgctgctgtcacgtcagtcccggcactggctgctgacacggttgtacaggctggggaaaccgtgaacggcggaacactgacaaatcatgacaaccagattgtcctcggtacggccaacggaatgaccatcagtaccgggctggaactggggccggacagtgaagaaaacaccggtgggcaatggatacagaatggcgggatagccggcaacaccactgtcaccacaaatggtcgtcaggtcgtgctggaggggggaacagccagtgatacggttattcgtgacggcgggggacagagcctgaacgggctggcggtgaacaccacgctgaataacagaggcgagcagtgggttcatgagggcggggttgccaccggtacaattatcaaccgcgacggttaccagagcgttaaaagtggcgggctggcaacaggaaccatcatcaacaccggcgcagaaggcggcccggattctgacaactcgtacacgggtcagaaggtccagggaacagcagaatccaccaccatcaacaaaaatggacggcagattatcttattttccgggatagcccgtgacactctcatttacgcaggtggtgaccagtcggtacacggaagggccctgaataccacactgaatggcggttaccagtatgtgcacaaggacggacttgcgctgaacacggtaattaacgaggggggctggcaggttgttaaggcaggtggtgctgtcggtaacaccaccataaatcagaacggtgaactgagggtacatgccggcggggaagccactgcagtcacccagaacacgggcggtgcactggttaccagtactgctgcaactgtcaccggcgcaaaccgcctggggcatttctccgtgggaaatggcatggcagataacgtcgttctggaaaatggcggtcgcctggatgtactggaaggccattcagcgcagaataccctggtggatgacggcggtaccctggcagtgtctgccggtggtaaggcaacagatgtcaccatgacatccggtggtgccctgatagcagacagtggtgccactgttgaggggaccaatgccagcggtaagttcagtattgatggcatatccggtcaggccagcggcctgctgctggaaaatggcggcagctttacggttaatgccgggggacaggctggcaacaccactgtcggacatcgtggaacactgactctggctgccgggggaagtctgagtggcagaacacagctcagtaaaggcgccagtatggtactgaatggtgatgtggtcagtaccggcgatattgttaacgcaggggagattcgctttgataatcagacgacacaggatgccgtcctgagccgtgctgttgcaaaaggcgactccccggtaacgttccataaactgaccaccaataacctcaccggtcagggtggcaccatcaatatgcgtgttcgccttgatggcagcaatgcctctgaccagttggtgattaatggtggtcaggcaaccggcaaaacctggcttgcgtttacaaatgtcggaaacagtaacctcggggtggcaacctccggacagggtatccgggttgtggatgcacagaatggtgccaccacagaagaaagtgcgtttgccctgagtcgcccgcttcacgccggcgcctttaactacaccctgaaccgtgacagcgatgaagactggtacctgcgcagtgaaaatgcttatcgtgctgaagtccccctgtatgcctccatgctgacacaggcaatggactatgaccggattctggcaggctcccgcagccatcagagcggtgtaagcggtgaaaataacagcgtccgtctcagcattcagggcggtcatctcgggcacgataacaacggtggtattgcccgtggggccacgccggaaagcaacggcagctatggcttcgtccgtctggagggtgacctgctcagaacagaggttgccggtatgtcactgacgacaggagtgtatggtgctgcaggccattcttccgttgatgttaagaatgatgacggctcccgtgccggcacggtccgggatgatgccggcagtctgggcggatacctgaatctggtacacacatcctccggcctgtgggctgacattgtggcacagggaacccaccacagcatgaaagcgtcatcggacaataacgacttccgcgcccggggctggggctggctgggctcactggaaactggtctgcccttcagtatcactgacaacctgatgctggagccacaactgcagtatacctggcagggactttccctggatgacggccaggataacgccggttatgtgaaattcgggcatggcagtgcacaacatgtacgtgccggtttccgtctgggcagccacaacgatatgacctttggtgaaggcacctcatcccgtgacaccctgcgcgacagtgcaaaacaccgtgtgcgtgaactgccggtgaactggtgggtacagccttctgttatccgcaccgtcagctcccggggtgacatgagcatgggtacagccgccgccggcagtaacatgacgttctcaccgtcccggaatggcacgtcactggacctgcaggccggactggaagcccgtgtccgggaaaatatcaccctgggcgttcaggccggttatgcccacagcgtcagcggcagcagcgctgaaggttataacggtcaggccacgctgaatatgactttc

SEQ ID NO: 136 - DNA, 2844 bp, Escherichia coli
atgaaacgacatctgaacaccagctacaggctggtatggaatcacattacgggtaccctggtggtggcctccgaactggcccgctcacggggaaaacgcgccggtgtggcgattgcgctgtctcttgctgctgtcacatcagtcccggcgctggctgctgacacggttgtacaggcgggtgaaaccgtgaacgacggaacactgacaaatcatgacaaccagattgttctcggtacggccaacggaatgaccatcagtaccggtctggagtatgggccggataacgaggccaataccggcgggcaatggatacaaaatggcggtatcgccaacaacactactgtcaccggtggtggtcttcagagagtgaatgccggaggaagcgtttcagacacggttatcagtgccggaggcggacagagccttcaggggcaggcagtgaataccactctgaacggcggtgagcagtgggtacatgaaggcgggattgcaacgggtaccgtcattaatgagaagggctggcaggccgtcaaatccggcgcaatggcaaccgacacggttgtgaataccggcgcggaagggggaccagatgcagaaaatggtgataccgggcagtttgttcgcggaaatgccgtacgcaccaccatcaataaaaatggtcgtcagattgtggctgctgaaggaacggcaaataccactgtggtttatgccggcggcgaccagactgtacatggtcacgcactggataccacgctgaatggggggtaccagtatgtgcacaacggcggtacggcgtctggcactgttgtaaacagtgacggctggcagattatcaaggaaggtggtctggcggatttcaccaccgttaaccagaaaggcaaactgcaggtgaacgccggtggtacagccacgaatgtcaccctgaagcagggaggcgcactggtcaccagtacggcggcaaccgtcaccggcagcaaccgtctgggcaatttcactgtggaaaacggtaaggctgacggtgttgttctggagtccggtggtcgcctggatgtactggagggccattcagcctggaaaacactggtggatgacggcggaaccctggcagtgtctgccggtggtaaggcaacagatgtcaccatgacatccggtggtgccctgattgcagacagtggtgccactgttgaggggaccaatgccagcggtaagttcagtattgatggcacatccggtcaggccagcggactgctgctggaaaatggcggcagctttacggttaatgccggaggactggccagcaacaccactgtcggacatcgtggaacactgacgctggctgccgggggaagtctgagtggcagaacacagctcagtaaaggtgccagcatggtactgaatggcgatgtggtcagtaccggcgatattgttaacgcaggggagattcgctttgataatcagacaacaccggatgccgtactgagccgtgctgttgcaaaaggcgactccccggtaacgttccataaactgacaaccagtaacctcaccggtcagggtggcaccatcaatatgcgtgttcgccttgatggcagcaatacctctgaccagctggtgattaatggtggtcaggcaaccggcaaaacctggcttgcgtttacaaatgtcggaaacagtaacctcggggtggcaacctccggacagggtatccgggttgtggatgcacagaatggtgccaccacagaagaaggtgcgtttgccctgagtcgcccgcttcaggccggagcctttaactacaccctgaaccgtgacagcgatgaagactggtacctgcgcagtgaaaatgcttatcgtgctgaagtccccctgtatgcctccatgctgacacaggcaatggactatgaccggattctggcaggctcccgcagccatcagaccggtgtaagcggtgaaaataacagcgtccgtctcagcattcagggcggtcatctcggtcacgataacaacggcggtattgcccgtggggccacgccggaaagcagcggcagctatggcttcgtccgtctggagggtgacctgctcagaacagaggttgccggtatgtctctgacgacaggggtgtatggtgctgcaggccattcttccgttgatgttaaggatgatgacggctcccgcgccggcacggcccgggatgatgccggcagtctgggcggatacctgaatctggtacacacatcctccggcctgtgggctgacattgtggcacagggaacccgccacagcatgaaagcatcatcggacaataacgacttccgcgcccggggctggggctggctgggctcactggaaaccggtctgcccttcagtatcactgacaatctgatgctggagccacaactgcagtacacctggcagggactctccctggatgacggccaggataacgccggttatgtgaagttcgggcatggcagtgcacaacatgtgcgtgccggcttccgtctgggcagccacaacgatatgaactttggtaaaggcacctcatcccgtgacaccctgcgcgacagtgccaaacacagtgtgcgtgaattgccggtgaactggtgggtacagccttctgttatccgcaccttcagctcccggggagacatgagcatgggtacagccgcagccggcagtaacatgacgttctcaccgtcccggaatggcacgtcactggacctgcaggccggactggaagcccgtgtccgggaaaatatcaccctgggcgttcaggccggttatgcccacagtgtcagcggcagcagcgctgaaggttataacggtcaggccacactgaacgtgactttc

SEQ ID NO: 137 - DNA, 2844 bp, Escherichia coli
atgaaacgacatctgaacaccagctacaggctggtatggaatcacattacgggcaccctggtggtggcttccgaactggcgcgctcacggggaaaacgcaccggtgtggcggttgcgctgtctcttgctgctgtcacgtcagtcccggtactggctgctgacacggtcgtacaggcgggagaaaccgtgagcggcggaacactgacaaatcatgacaaccagattgtcttcggtacggccaacggaatgaccatcagtaccggtctggagtatgggccggataacgaggccaataccggcggacaatggatacaaaatggcggtatcgccaacaacactactgtcaccggtggtggtcttcagagagtgaatgccggaggaagcgtttcagacacggttatcagtgccggaggcggacagagccttcaggggcaggcagtgaacaccactctgaacggcggtgagcagtgggtacatgaaggcgggattgcaacgggtaccgtcattaatgagaagggctggcaggccgtcaaatccggcgcaatggcaaccgacacggttgtgaataccggcgcggaagggggaccggatgcagaaaatggtgataccgggcagtttgttcgcggaaatgccgtacgtaccactatcaatgaaaatggtcgtcagattgtggctgctgaaggaacagcaaataccactgtggtttatgccggcggcgaccagacggtacacgggcatgcgctggataccacactgaatggcggttaccagtatgtgcacaacggaggcacagcctctgacacggttgtaaacagtgacggctggcagattgtcaaggaaggtggtctggcggatttcaccaccgttaaccagaaaggcaaactgcaggtgaacgccggtggtacagccacgaatgtcaccctgaagcagggaggcgcactggtcaccagtacggcggcaaccgtcaccggcagcaaccgtctgggcaatttcactgtggaaaacggtaatgctgacggtgttgttctggagtccggtggtcgcctggatgtactggagggccattcagcctggaaaacactggtggatgacggcggaaccctggcagtgtctgccggtggtaaggcaacagatgtcaccatgacatccggtagtgccctgattgcagacagtggtgccactgttgaggggaccaatgccagcggtaagttcagtattgatggcacatccggtcaggccagcggactgctgctggaaaatggcggcagctttacggttaatgccggaggactggccagcaacaccactgtcggacatcgtggaacactgacgctggctgccgggggaagtctgagtggcagaacacagctcagtaaaggtgccagcatggtactgaatggcgatgtggtcagtaccggcgatattgttaacgcaggggagattcgctttgataatcagacgacaccggatgccgcgctgagccgtgctgttgcaaaaggcgactccccggtaacgttccataaactgaccaccagtaacctcaccggtcagggtggcaccatcaatatgcgtgttcgccttgatggcagcaatacctctgaccagctggtgattaatggtggtcaggcaaccggcaaaacctggcttgcgtttacaaatgtcggaaacagtaacctcggggtggcaacctccggacagggtatccgggttgtggatgcacagaatggcgccaccacagaagaaggtgcgtttgccctgagtcgcccgcttcaggccggcgcctttaactacaccctgaaccgtgacagcgatgaagactggtacctgcgcagtgaaaatgcttatcgtgctgaagtccccctgtatacatccatgctgacacaggcaatggactatgaccggattctggcaggctcccgcagccatcagaccggtgtaaacggtgaaaataacagcgtccgtctcagcattcagggcggtcatctcggtcacgataacaacggcggtattgcccgtggagccacgccggaaagcagcggcagctatggcttcgtccgtctggagggtgacctgctcagaacagaggttgccggtatgtctctgacgacaggggtgcatggtgccgcaggccattcttccgttgatgttaaggatgatgacggttcccgcgccggcacggtccgggatgatgccggcagcctgggcggatacctgaatctgacacacacgtcctccggcctgtgggctgacattgtggcacagggaacccgccacagcatgaaagcgtcatcggacaataacgacttccgcgcccgcggctggggctggctgggctcactggaaaccggtctgcccttcagtatcactgacaacctgatgctggagccacaactgcagtatacctggcagggactttccctggatgacggccaggataacgccggttatgtgaagttcgggcatggcagtgcacaacatgtgcgtgccggtttccgtctgggcagccacaacgatatgagctttggtgaaggcacctcatcccgtgacaccctgcgcgacagtgcaaaacaccgtgtgcgtgaactgccggtgaactggtgggtacagccttctgttatccgcaccttcagttcccggggtgacatgagcatggggacagccgccgccggcagtaacatgacgttctcaccgtcccggaatggcacgtcactggacctgcaggccggactggaagcccgtgtccgggaaaatatcaccctgggcgttcaggccggttatgcccacagtgtcagcggcagcagcgctgaaggttataacggtcaggccacgctgaatgtgactttc

SEQ ID NO: 138 - DNA, 2847 bp, Escherichia coli
atgaaacgacatctgaacaccagctacaggctggtatggaatcacattacgggcaccctggtggtggcctccgaactggcccgctcacggggaaaacgcgccggtgtggcggttgcgctgtctcttgctgctgtcacatcagtcccggcactggctgctgacaaggttgtacaggcgggagaaaccgtgaacgatggaacactgacaaatcatgacaaccagattgtcttcggtacggccaacggaatgaccatcagtaccgggctggaactggggccggacagtgaagaaaacaccggtgggcaatggatacagaatggcgggatagccggaaacaccactgtcaccacaaatggtcgtcaggtcgtgctggaggggggaacagccagtgatacggttattcgtgacggcgggggacagagcctgaacggactggcggtgaacaccacactgaataacagaggcgagcagtgggtgcatgagggcggggttgccaccggtacaattatcaaccgcgacggttaccagagcgttaaaagtggcgggctggcaacaggaaccatcatcaacaccggcgcagaaggcggccctgattctgacaactcgtatacgggtcagaaggtccagggaacagcagaatccaccaccatcaacaaaaatggacggcagattatcttattttccgggctagcccgtgacactctcatttacgcaggtggtgaccagtcggtacacggaagggccctgaataccacactgaatggcggttaccaatatgtgcacagggacggacttgcgctgaacacggtaattaacgaggggggctggcaggttgttaaggcaggtggcgctgccggtaacaccaccataaatcagaacggtgaactgagggtacatgccggcggggaagccactgcagtcacccagaacacgggcggtgcactggttaccagtactgctgcaactgtcatcggcacaaaccgtctggggaatttcacggtggaaaacggtaaggctgacggtgttgttctggaatccggcggtcgtctggatgtactggagagccattcagcacagaataccctagtggatgacggcggtaccctggcagtgtctgccggcggtaaggcgacaagtgtcaccataacatccggtggtgccctgattgcagacagtggtgccactgttgaggggaccaatgccagcggtaagttcagtattgatggcacatccggtcaggccagcggcctgctgctggaaaatggcggcagctttacggttaatgccgggggacaggctggcaacaccactgtcggacatcgtggaacactgacgctggctgccgggggaagtctgagtggcagaacacagctcagtaaaggcgccagtatggtactgaatggtgatgtggtcagtaccggcgatattgttaacgcaggggagattcgctttgataatcagacgacaccgaatgccgcgctgagccgtgctgttgcaaaaagtaactccccggtaacgttccataaactgaccaccacgaacctcaccggccagggcggcaccatcaatatgcgtgttcgccttgatggcagcaatgcctctgaccagctggtgattaatggtggtcaggcaaccggcaaaacctggcttgcgtttacaaatgtcggaaacagcaacctcggggtggcaaccaccggacagggtatccgggttgtggatgcacagaatggcgccaccacagaagaaggtgcgtttgccctgagtcgcccgcttcaggccggcgcctttaactacaccctgaaccgtgacagcgatgaagactggtacctgcgcagtgaaaatgcttatcgtgctgaagtccccctgtatacatccatgttgacacaggcaatggactatgaccggattctggcaggctcccgcagccatcagaccggtgtaaacggtgaaaataacagcgtccgtctcagcattcagggcggtcatctcggtcacgataacaacggcggtattgcccgtggagccacgccggaaagcagcggcagctatggcttcgtccgtctggagggtgacctgctcagaacagaggttgccggtatgtctctgacgacaggggtgtatggtgctgcaggccattcttccgttgatgttaaggatgatgacggttcccgcgccggcacggtccgggatgatgccggcagtctgggcggatacctgaatctggtacacacatcctccggcctgtgggctgacattgtggcccagggaacccgtcacagcatgaaagcgtcatcggacaataacgacttccgcgcccggggctggggctggctgggctcactggaaaccggtctgcccttcagtatcactgacaatctgatgctggagccacaactgcagtacacctggcagggactctccctggatgacggccaggataacgccggttatgtgaagttcgggcatggcagtgcacaacatgtgcgtgccggtttccgtctgggcagccacaacgatatgacctttggtgaaggcacctcatcccgtgacaccctgcgcgacagtgcaaaacacagtgtgagtgaactgccggtgaactggtgggtacagccttctgttatccgcaccttcagctcccggggtgacatgagcatggggacagccgcagccggcagtaacatgacgttctcaccgtcccggaatggcacgtcactggacctgcaggccggactggaagcccgtatccgggaaaatatcaccctgggcgttcaggccggttatgcccacagcgtcagcggcagcagcgctgaaggctataacggtcaggctacgctgaatatgactttc

SEQ ID NO: 139 - DNA, 2844 bp, Escherichia coli
atgaaacgacatctgaacaccagctacaggctggtatggaatcacattacaggcaccctggtggtggcttccgaactggcacgctcacggggaaaaggcgccggtgtggcggttgctctgtctcttgctgctgtcacgtcagtcccggcactggctgctgacacggttgtacaggcgggagaaaccgtgaacggcggaacactgacaaatcatgacaaccagattgtcctcggtacggccaacggaatgaccatcagtaccgggctggagtatgggccggataacgaggccaataccggcgggcaatggatacaaaatggcggtatcgccaacaacactactgtcaccggtggtggtcttcagagagtgaatgccggaggaagcgtttcagacacggttatcagtgccggaggcggacagagccttcaggggcaggcagtgaacaccactctgaacggcggtgagcagtgggtacatgaaggcgggattgcaacgggtaccgtcattaatgagaagggctggcaggccgtcaaatccggtgcaatggcaaccgacacggttgtgaataccggcgcggaaggaggaccggatgcggaaaatggtgataccgggcagaccgtctacggagatgccgtacgcaccaccatcaataaaaatggtcgtcagattgtggctgctgaaggaacggcaaataccactgtggtttatgccggcggcgaccagactgtacatggtcacgcactggataccacgctgaatggggggtaccagtatgtgcacaacggaggtacagcatctgacactgttgttaacagtgacggctggcagattatcaaggaaggtggtctggcggatttcaccaccgttaaccagaaaggtaaactgcaggtgaacgccggtggtacagccacgaatgtcaccctgacgcagggcggcgcactggtcaccagtacggcggcaaccgtcaccggcagcaaccgtctgggcaatttcactgtggaaaacggtaatgctgacggtgttgttctggagtccggtggtcgcctggatgtactggagggccattcagcctggaaaacactggtggatgacggcggtaccctggcagtgtctgccggtggtaaggcaacagatgtcaccatgacatccggtggtgccctgattgcagacagtggtgccactgttgaggggaccaatgccagcggtaagttcagtattgatggcatatccggtcaggccagcggcctgctgctggaaaatggcggcagctttacggttaatgccggaggactggccagcaacaccactgtcggacatcgtggaacactgacgctggccgccgggggaagtctgagtggcagaacacagctcagtaaaggcgccagtatggtactgaatggtgatgtggtcagtaccggcgatattgttaacgccggagagattcgctttgataatcagacgacaccggatgccgcactgagccgtgctgttgcaaaaggcgactccccggtaacgttccataaactgaccaccagtaacctcaccggtcagggtggcaccatcaatatgcgtgttcgccttgatggcagcaatgcctctgaccagctggtgattaatggtggtcaggcaaccggcaaaacctggcttgcgtttacaaatgtcggaaacagtaacctcggggtggcaacctccggacagggtatccgggttgtggatgcacagaatggtgccaccacagaagaaggtgcgtttgccctgagtcgcccgcttcaggccggcgcctttaactacaccctgaaccgtgacagcgatgaagactggtacctgcgcagtgaaaatgcttatcgtgctgaagtccccctgtatgcctccatgctgacacaggcaatggactatgaccggattctggcaggctcccgcagccatcagagcggtgtaagcggtgaaaataacagcgtccgtctcagcattcagggcggtcatctcgggcacgataacaacggtggtattgcccgtggggccacgccggaaagcaacggcagctatggcttcgtccgtctggagggtgacctgctcagaacagaggttgccggtatgtcactgacgacaggagtgtatggtgctgcaggccattcttccgttgatgttaaggatgatgacggctcccgcgccggcacggtccgggatgatgccggcagcctgggcggatacctgcatctggtacacacgtcctccggcctgtgggctgacattgtggcacagggaacccgccacagcatgaaagcgtcatcggacaataacgacttccgcgcccggggctggggctggctgggctcactggaaaccggtctgcccttcagtatcactgacaacctgatgctggagccacaactgcagtacacctggcagggactctccctggatgacggccaggataacgccggttatgtgaagttcgggcatggcagtgcacaacatgtgcgtgccggcttccgtctgggcagccacaacgatatgaactttggtaaaggcacctcatcccgtgacaccctgcacgacagtgcaaaacacagtgtgcgtgaactgccggtgaactggtgggtacagccttctgttatccgcaccttcagctcccggggagacatgagcatgggtacagccgcagccggcagtaacatgacgttctcaccgtcccggaatggcacgtcactggacctgcaggccggactggaagcccgtgtccgggaaaatatcaccctgggcgttcaggccggttatgcccacagtgtcagcggcagcagcgctgaaggttataacggtcaggccacactgaacgtgactttc

SEQ ID NO: 140 - DNA, 3117 bp, Escherichia coli
atgaaacgacatctgaatacctgctacaggctggtatggaatcacatgacgggcgctttcgtggttgcctccgaactggcccgcgcacggggtaaacgtggcggtgtggcggttgcactgtctcttgccgcagtcacgtcactcccggtgctggctgctgacatcgttgtgcacccgggagaaaccgtgaacggcggaacactggcaaatcatgacaaccagattgtcttcggtacgaccaacggaatgaccatcagtaccgggctggagtatgggccggataacgaggccaataccggcgggcaatgggtacaggatggcggaacagccaacaaaacgactgtcaccagtggtggtcttcagagagtgaaccccggtggaagtgtctcagacacggttatcagtgccggaggcggacagagccttcagggacgggctgtgaacaccacgctgaatggtggcgaacagtggatgcatgagggggcgatagccacaggaaccgtcattaatgataagggctggcaggtcgtcaagcccggtacagtggcaacggataccgttgttaataccggggcggaagggggaccggatgcagaaaacggtgataccgggcagtttgttcgcggggatgccgtacgcacaaccatcaataaaaacggtcgccagattgtgagagctgaaggaacggcaaataccactgtggtttatgccggcggcgaccagactgtacatggtcacgcactggataccacgctgaatgggggataccagtatgtgcacaacggcggtacagcgtctgacactgttgtgaacagtgacggctggcagattgtcaaaaacgggggtgtggccgggaataccaccgttaatcagaagggcagactgcaggtggacgccggtggtacagccacgaatgtcaccctgaagcagggcggcgcactggttaccagtacggctgcaaccgttaccggcataaaccgcctgggagcattctctgttgtggagggtaaagctgataatgtcgtactggaaaatggcggacgcctggatgtgctgaccggacacacagccactaatacccgcgtggatgatggcggaacgctggatgtccgcaacggtggcaccgccaccaccgtatccatgggaaatggcggtgtactgctggccgattccggtgccgctgtcagtggtacccggagcgacggaaaggcattcagtatcggaggcggtcaggcggatgccctgatgctggaaaaaggcagttcattcacgctgaacgccggtgatacggccacggataccacggtaaatggcggactgttcaccgccaggggcggcacactggcgggcaccaccacgctgaataacggcgccatacttaccctttccgggaagacggtgaacaacgataccctgaccatccgtgaaggcgatgcactcctgcagggaggctctctcaccggtaacggcagcgtggaaaaatcaggaagtggcacactcactgtcagcaacaccacactcacccagaaagccgtcaacctgaatgaaggcacgctgacgctgaacgacagtaccgtcaccacggatgtcattgctcagcgcggtacagccctgaagctgaccggcagcactgtgctgaacggtgccattgaccccacgaatgtcactctcgcctccggtgccacctggaatatccccgataacgccacggtgcagtcggtggtggatgacctcagccatgccggacagattcatttcacctccacccgcacagggaagttcgtaccggcaaccctgaaagtgaaaaacctgaacggacagaatggcaccatcagcctgcgtgtacgcccggatatggcacagaacaatgctgacagactggtcattgacggcggcagggcaaccggaaaaaccatcctgaacctggtgaacgccggcaacagtgcgtcggggctggcgaccagcggtaagggtattcaggtggtggaagccattaacggtgccaccacggaggaaggggcctttgtccaggggaacaggctgcaggccggtgcctttaactactccctcaaccgggacagtgatgagagctggtatctgcgcagtgaaaatgcttatcgtgcagaagtccccctgtatgcctccatgctgacacaggcaatggactatgaccggattgtggcaggctcccgcagccatcagaccggtgtaaatggtgaaaacaacagcgtccgtctcagcattcagggcggtcatctcggtcacgataacaatggcggtattgcccgtggggccacgccggaaagcagcggcagctatggattcgtccgtctggagggtgacctgatgagaacagaggttgccggtatgtctgtgaccgcgggggtatatggtgctgctggccattcttccgttgatgttaaggatgatgacggctcccgtgccggcacggtccgggatgatgccggctgcctgggcggatacctgaatctggtacacacgtcctccggcctgtgggctgacattgtggcacagggaacccgccacagcatgaaagcgtcatcggacaataacgacttccgcgcccggggctggggctggctgggctcactggaaaccggtctgcccttcagtatcactgacaacctgatgctggagccacaactgcagtatacctggcagggactttccctggatgacggtaaggacaacgccggttatgtgaagttcgggcatggcagtgcacaacatgtgcgtgccggtttccgtctgggcagccacaacgatatgacctttggcgaaggcacctcatcccgtgcccccctgcgtgacagtgcaaaacacagtgtgagtgaattaccggtgaactggtgggtacagccttctgttatccgcaccttcagctcccggggagatatgcgtgtggggacttccactgcaggcagcgggatgacgttctctccctcacagaatggcacatcactggacctgcaggccggactggaagcccgtgtccgggaaaatatcaccctgggcgttcaggccggttatgcccacagcgtcagcggcagcagcgctgaagggtataacggtcaggccacactgaatgtgaccttc

SEQ ID NO: 141 - DNA, 2844 bp, Escherichia coli
atgaaacgacatctgaacaccagctacaggctggtatggaatcacattacgggcaccctggtggtggcttccgaactggcccgctcacggggaaaacgcgccggtgtggcggttgcgctgtctcttgctgctgtcacgccagtcccggcactggctgctgacacggttgtagaggcgggagaaaccgtgaacggcggaacactgacaaatcatgacaaccagattgtcttcggtacgaccaacggaatgaccatcagtaccgggctggagtatgggacggataacgaggccaataccggcgggcaatgggtacaggatggcggcacagccagtaataccaccatcagcagcggcgggctccagtttgtaggtgccgggggaaaggctacagacacaataatcaatgaaggaggcggacaaagcctgaagggactggcactgaacaccacgctgaatggtggcgagcagtggatgcatgaaggtgcgatagccacaggaaccgtcattaatgataagggctggcaggtcgtcaaacccggcgcagtggcaacagacaccgttgtgaataccggcgcagaaggaggaccggatgcagaaaatggtgataccgggcagtttgttcgcggaaatgccgtacgtaccaccatcaataaaaatggtcgtcagattgtgactgttgaaggaacagcaaataccactgtggtttatgccggcggcgaccagacggtacatggccacgcactggataccacgctgaatggcggtaaccagtatgtacacaacggcggtacaacgtctgacactgttgtgaacagtgacggctggcagattatcaaggaaggtggtctggcggatttcaccaccgttaaccagaaaggcaaactgcaggtgaacgccggtggtacagccacgaatgtcaccctgaagcagggaggcgcactggtcaccagtacggcggcaaccgtcaccggcagcaaccgtctgggcaatttcgcggtggaaaacggtaaggctgacggtgttgttctggagtccggcggtcgtctggatgtactggagggtcattcagcgcagaaaacacgggtggatgacggcggtaccctggcagtgtctgccggtggtaaggcgacaggtgtcaccatgacatccggtggtgccctgattgcagacagtggtgccactgttgaggggaccaatgccagcggtaagttcagtattgatggcatatccggtcaggccagcggcctgctgctggaaaatggcggcagctttacggttaatgccgggggacaggctggcaacaccactgtcggacatcgtggaacactgacgctggctgccgggggaagtctgagtggcagaacacagctcagtaaaggcgccagcatggtactgaatggtgatgtggtcagtaccggcgatattgttaacgcaggggagattcgctttgataatcagacgacacaggatgccgtcctgagccgtgctgttgcaaaaggcgacgccccggtaacgttccataaactgaccaccagtaacctcaccggtcagggtggcaccatcaatatgcgtgttcgccttgatggcagcaatgcctctgaccagctggtgattaatggtggtcaggcaaccggcaaaacctggcttgcgttcacaaatgtcggaaacagtaacctcggggtggcaacttccggacagggtatccgggttgtggatgcacagaatggtgccaccacagaagaaggtgcgtttgccctgagtcgcccgcttcaggccggtgcctttaactacaccctgaaccgtgacagcgatgaagactggtacctgcgcagtgaaaatgcttatcgtgctgaagtccccctgtatgcctccatgctgacacaggcaatggactatgaccggattctggcaggctcccgcagccatcagaccggtgtaaacggtgaaaataacagcgtccgtctcagcattcagggcggtcatctcggtcacgataacaacggcggtattgcccgtggggccacgccggaaagcagcggcagctatggcttcgtccgtctggagagtgacctgctgagaacagaggttgccggtatgtctgtgaccgcgggggtatatagtgctgctggccattcttccgttgatgttaaggatgatgacggctcccgcgccggcacggtccgggatgatgccggcagcctgggcggatacctgaatctggtacacacgtcctccggcctgtgggctgacattatggcacagggaacccgccacagcatgaaagcgtcatcggacaataacgacttccgcgcccggggctggggctggctgggctcactggaaaccggtctgcccttcagtatcactgacaacctgatgctggaaccacaactgcagtacacctggcagggactttccctggatgacggccaggataacgccggttatgtgaagttcgggcatggcagtgcacaacatatgcgtgccggcttccgtctgggcagccacaacgatatgagctttggtgaaggcacctcatcccgtgacaccctgcgcgacagtgcaaaacaccgtgtgcgtgaactgccggtgaactggtgggtacagccttctgttatccgcaccttcagttcccggggtgacatgagcatggggacagccgccgccggcagtaacatgacgttctcaccgtcccagaatggcacgtcactggacctgcaggccggactggaagcccgtgtccgggaaaatatcaccctgggcgttcaggccggttatgcccacagcgtcagcggcagcagcgccgaaggctataacggtcaggccacgctgaatgtgactttc

SEQ ID NO: 142 - DNA, 2844 bp, Escherichia coli
atgaaacgacatctgaacaccagctacaggctggtatggaatcacattacgggtaccctggtggtggcctccgaactggcccgctcacggggaaaacgcgccggtgtggcgattgcgctgtctcttgctgctgtcacatcagttccggcactggctgctgacacggttgtacaggcgggagaaaccgtgagcggcggaacactgacaaatcatgacaaccagattgtcttcggtacggccaacggaatgaccatcagtagcgggctggagtatgggccggataacgaggccaataccggcggccaatggatacaaaatggcggtatcgccaacaacactactgtcaccggtggtggtcttcagagagtgaatgccggaggaagcgtttcagacacggttatcagtgccggaggcggacagagccttcaggggcaggcagtgaataccactctgaacggcggtgagcagtgggtacatgaaggcgggattgcaacgggtaccgtcattaatgagaagggctggcaggccgtcaaatccggcgcaatggcaaccgacacggttgtgaataccggcgcggaagggggaccagatgcagaaaatggtgataccgggcagtttgttcgcggaaatgccgtacgcaccaccatcaataaaaatggtcgtcagattgtggctgctgaaggaacggcaaataccactgtggtttatgccggcggcgaccagactgtacatggtcacgcactggataccacgctgaatggggggtaccagtatgtgcacaacggcggtacggcgtctggcactgttgtaaacagtgacggctggcagattatcaaggaaggtggtctggcggatttcaccaccgttaaccagaaaggcaaactgcaggtgaacgccggtggtaccgccacacatgtcaccctgaaacagggtggagcactggttaccagtactgcggcaacggttcttggcagcaaccgtctgggcaatttcacggtggaaaacggtaaggctgacggcgttgttctggagtccggcggtcgcctggatgtactggaaggccattcagcgcagaaaacacgggtggatgacggcggaaccctggcagtgtctgccggtggtaaggcaacaggtgtcaccatgacatccggtggtgccctgattgcagacagtggtgccactgttgaggggaccaatgccagcggtaagttcagtattgatggcacatccggtcaggccagcggcctgctgctggaaaatggcggcagctttacggttaatgccgggggacaggccagcaacaccactgtcggacatcgtggaacactgatgctggctgccgggggaagtctgagtggcagaacacagctcagtaaaggcgccagcatggtactgaatggtgatgtggtcagtaccggcgatattgttaacgcaggagagattcactttgataatcagacgacacaggatgccgtactgagccgtgctgttgcaaaaagtaactccccggtaacgttccataaactgaccaccacgaacctcaccggccagggtggcaccatcaatatgcgtgtcagccttgatggcagtaatgcctctgaccagctggtgattaatggtggtcaggcaaccggcaaaacctggcttgcgtttacaaatgtcggaaacagtaacctcggggtggcaacctccggacagggtatccgggttgtggatgcacagaatggcgccaccacagaagaaggtgcgtttgccctgagtcgcccgcttcaggccggcgcctttaactacaccctgaaccgtgacagcgatgaagactggtacctgcgcagtgaaaatgcttatcgtgctgaagtccccctgtatacatccatgctgacacaggcaatggactatgaccggattctggcaggctcccgcagccatcagaccggtgtaaacggtgaaaataacagcgtccgtctcagcattcagggcggtcatctcggtcacgataacaacggcggtattgcccgtggagccacgccggaaagcagcggcagctatggcttcgtccgtctggagggtgacctgctgagaacagaggttgccggtatgtctctgacgacaggggtgtatggtgccgcaggccattcttccgttgatgttaaggatgatgacggttcccgcgccggcacggtccgggatgatgccggcagcctgggcggatacctgaatctgacacacacgtcctccggcctgtgggctgacattgtggcacagggaacccgccacagcatgaaagcgtcatcggacaataacgacttccgcgcccggggctggggctggctgggctcactggaaaccggtctgcccttcagtatcactgacaacctgatgctggagccacaactgcactatacctggcagggactttccctggatgacggccaggataacgccggttatgtgaagttcgggcatggcagtgcacaacatgtgcgtgccggcttccgtctgggcagccacaacgatatgacctttggtgaaggcacctcatcccgtgacaccctgcgcgacagtacaaaacacggtgtgagtgaactgcctgtgaactggtgggtacagccttctgttatccgcaccttcagctcccggggagacatgagcatgggtacagccgcagccggcagtaacatgacgttctcaccgtcccggaatggcacgtcactggacctgcaggccggactggaagcccgtgtccgggaaaatatcaccctgggcgttcaggccggttatgcccacagtgtcagcggcaacagcgctgaaggctataacggtcaggccacgctgaatgtgactttc

SEQ ID NO: 143 - DNA, 2844 bp, Escherichia coli
atgaaacgacatctgaacaccagctacaggctggtatggaatcacattacgggcaccctggtggtggcctccgaactggcccgctcacggggaaaacgcaccggtgtggcagttgcgctgtctcttgccaccgccacttcagtcccggccctggctgctgacagtgttgtacaggcgggagaaaccgtgagcggcggaacactggaaaatcatgacaaccagattgtcttcggtacgaccaacggaataaccatcagtaccgggctggagtatgggccggataacgaggccaatactggcgggcaatgggtacaggatggcggcacagccagtaataccaccatcagcagcggtgggctccagtttgtaggtgccgggggaaaggctacagacacaataatcaatgaaggaggcggacaaagtctgaagggactggcactgaacaccacgctgaatggtggcgagcagtggatgcatgaaggtgcgatagccacaggaaccgtcattaatgataagggctggcaggtcgtcaaacccggcgcagtggcaacagacaccgttgtgaataccggcgcggaaggaggaccggatgcagaaaatgctgataccggacagtttgttcgcggagatgccgtacgtaccaccatcaataaaaatggtcgtcagattgtggtagccaccggagtggcaaacaccacggtggtttatgccggcggcgaccagactgtgcatggctacgcgctggataccacactgaacggcggtaaccagtatgtgcacaacggcggtacagcgtccgacactgttgtgaacagtgacggctggcagattatcaaggagggtggtctggcggatttcaccaccgttaaccagaaaggcaaactgcaggtgaacgccggtggtacagccacgaatgtcaccctgaagcagggcggcgcactggtcaccagtacagcagcaactgttcttggcagcaaccgtctggggaatttcacggtggaaaacggtaaggctgacggtgttgttctggagtccggtggtcgcctggatgtactggagggccattcagcctggaaaacactggtggatgacggcggtatcctggcagtgtctgccggtggtaaggcaacagatgtcaccatgacatccggtggtgccctgattgcagacagtggtgccactgttgaggggaccaatgccagcggtaagttcagtattgatggtatatccggtcaggccagcggcctgctgctggaaaatggcggcagctttacggttaatgccgggggacaggctggcaacaccactgtcggacatcgtggaacactgacgctggctgccgggggaagtctgagtggaagaacacagctcagtaaaggcgccagtatggtactgaatggtgatgtggtcagtaccggcgatattgttaacgcaggagagattcactttgataatcagacgacacaggatgccgtactgagccgtgctgttgcaaaaagtaactccccggtaacgttccataaactgaccaccacgaacctcaccggccagggtggcaccatcaatatgcgtgtcagccttgatggcagtaatgcctctgaccagctggtgattaatggtggtcaggcaaccggcaaaacctggcttgcgtttacaaatgtcggaaacagtaacctcggggtggcaacctccggacagggtatccgggttgtggatgcacagaatggcgccaccacagaagaaggtgcgtttgccctgagtcgcccgcttcaggccggcgcctttaactacaccctgaaccgtgacagcgatgaagactggtacctgcgcagtgaaaatgcttatcgtgctgaagtccccctgtatacatccatgctgacacaggcaatggactatgaccggattctggcaggctcccgcagccatcagaccggtgtaaacggtgaaaataacagcgtccgtctcagcattcagggcggtcatctcggtcacgataacaacggcggtattgcccgtggagccacgccggaaagcagcggcagctatggcttcgtccgtctggagggtgacctgctgagaacagaggttgccggtatgtctgtgaccgcgggggtatatggtgctgctggccattcttccgttgatgttaaggatgatgacggctcccgcgccggcacggtccgggatgatgccggcagtctgggcggatacctgaatctggtacacacgtcctccggcctgtgggctgacattgtggcacagggaacccgccacagcatgaaagcgtcaacggacaataacgacttccgcgcccggggttggggctggctgggttcactggaaaccggtctgcccttcagtatcactgacaacctgatgctggagccacaactgcagtatacctggcagggactttccctggatgacggtaaggacaacgccggttatgtgaagttcgggcatggcagtgcacaacatgtgcgtgccggtttccgtctgggcagccacaacgatatgacctttggcgaaggcacctcatcccgtgcccccctgcgtgacagtgcaaaacacagtatgcgtgaactgccggtgaactggtgggtacagccttctgttatccgcaccttcagctcccggggagacatgagcatgggtacagccgcagccggcagtaacatgacgttctcaccgtcccggaatggcacgtcactggacctgcaggccggactggaagcccgtgtccgggaaaatatcactctgggcgttcaggccggttatgcccacagcgtcatcggcagcagcgctgaagggtataacggtcaggccacactgaatgtgaccttc

SEQ ID NO: 144 - DNA, 3117 bp, Escherichia coli
atgaaacgacatctgaatacctgctacaggctggtatggaatcacattacgggcgctttcgtggttgcctccgaactggcccgcgcacggggtaaacgtggcggtgtggcggttgcactgtctcttgccgcagtcacgtcactcccggtgctggctgctgacatcgttgtgcacccgggagaaaccgtgaacggcggaacactggcaaatcatgacaaccagattgtcttcggtacgaccaacggaatgaccatcagtaccgggctggagtatgggccggataacgaggccaataccggcgggcaatgggtacaggatggcggaacagccaacaaaacgactgtcaccagtggtggtcttcagagagtgaaccccggtggaagtgtctcagacacggttatcagtgccggaggcggacagagccttcagggacgggcagtgaacaccacgctgaatggtggcgaacagtggatgcatgagggggcgatagccacaggaaccgtcattaatgataagggctggcaggtcgtcaagcccggtacagtggcaacggataccgttgttaataccggggcggaagggggaccggatgcagaaaacggtgataccgggcagtttgttcgcggggatgccgtacgcacaaccatcaataaaaacggtcgccagattgtgagagctgaaggaacggcaaataccactgtggtttatgccggcggcgaccagactgtacatggtcacgcactggataccacgctgaatgggggataccagtatgtgcacaacggcggtacagcgtctgacactgttgtgaacagtgacggctggcagattgtcaaaaacgggggtgtggccgggaataccaccgttaatcagaagggcagactgcaggtggacgccggtggtacagccacgaatgtcaccctgaagcagggcggcgcactggttaccagtacggctgcaaccgttaccggcataaaccgcctgggagcattctctgttgtggagggtaaagctgataatgtcgtactggaaaatggcggacgcctggatgtgctgaccggacacacagccactaatacccgcgtggatgatggcggaacgctggatgtccgcaacggtggcaccgccaccaccgtatccatgggaaatggcggtgtactgctggccgattccggtgccgctgtcagtggtacccggagcgacggaaaggcattcagtatcggaggcggtcaggcggatgccctgatgctggaaaaaggcagttcattcacgctgaacgccggtgatacggccacggataccacggtaaatggcggactgttcaccgccaggggcggcacactggcgggcaccaccacgctgaataacggcgccatacttaccctttccgggaagacggtgaacaacgataccctgaccatccgtgaaggcgatgcactcctgcagggaggctctctcaccggtaacggcagcgtggaaaaatcaggaagtggcacactcactgtcagcaacaccacactcacccagaaagccgtcaacctgaatgaaggcacgctgacgctgaacgacagtaccgtcaccacggatgtcattgctcagcgcggtacagccctgaagctgaccggcagcactgtgctgaacggtgccattgaccccacgaatgtcactctcgcctccggtgccacctggaatatccccgataacgccacggtgcagtcggtggtggatgacctcagccatgccggacagattcatttcacctccacccgcacagggaagttcgtaccggcaaccctgaaagtgaaaaacctgaacggacagaatggcaccatcagcctgcgtgtacgcccggatatggcacagaacaatgctgacagactggtcattgacggcggcagggcaaccggaaaaaccatcctgaacctggtgaacgccggcaacagtgcgtcggggctggcgaccagcggtaagggtattcaggtggttgaagccattaacggtgccaccacggaggaaggggcctttgtccaggggaacaggctgcaggccggtgcctttaactactccctcaaccgggacagtgatgagagctggtatctgcgcagtgaaaatgcttatcgtgcagaagtccccctgtatgcctccatgctgacacaggcaatggactatgaccggattctggcaggctcccgcagccatcagaccggtgtaagcggtgaaaataacagcgtccgtctcagcattcagggcggtcatctcggtcacgataacaacggcggtattgcccgtggggccacgccggaaagcagcggcagctatggcttcgtccgtctggagggtgacctgctcagaacagaggttgccggtatgtctctgacgacaggggtgtatggtgctgcaggccattcttccgttgatgttaaggatgatgacggctcccgcgccggcacggtccgggatgatgccggcagcctgggcggatacctgaatctgacacacacgtcctccggcctgtgggctgacattgtggcacagggaacccgccacagcatgaaagcgtcatcggataataacgacttccgcgcccggggctggggctggctgggctcactggaaaccggtctgcccttcagtatcactgacaacctgatgctggagccacaactgcactatacctggcagggactttccctggatgacggccaggataacgccggttatgtgaagttcgggcatggcagtgcacaacatgtgcgtgccggtttccgtctgggcagccacaacgatatgacctttggtgaaggcacctcatcccgtgacaccctgcgcgacagtacaaaacacggtgtgagtgaactgcctgtgaactggtgggtacagccttctgttatccgcaccttcagctcccggggagacatgagcatgggtacagccgcagccggcagtaacatgacgttctcaccgtcccagaatggcacatcactggacctgcaggccggactggaagcccgtgtccgggaaaatatcaccctgggcgttcaggccggttatgcccacagcgtcagcggcagcagcgctgaagggtataacggtcaggccacactgaatgtgaccttc

SEQ ID NO: 145 - DNA, 3117 bp, Escherichia coli
atgaaacgacatctgaatacctgctacaggctggtatggaatcacattacgggcgctttcgtggttgcctccgaactggcccgcgcacggggtaaacgtggcggtgtggcggttgcactgtctcttgccgcagtcacgtcactcccggtgctggctgctgacatcgttgtgcacccgggtgaaacagtgaatggcggaacactggtaaaccatgacaaccagtttgtatccggaacagctgatggcgtgactgtcagtaccgggcttgagctggggccggactctgatgacaacaccggcggtcagcagatagcccggggtggcactgccagaaacaccacggtcaccgcaaacggtctgcaggatgtcatggcaggtggcagtgccacggatacggttatcagtgccggtggaggacagaatctgcgcgggcaggcttacggtactgtccttaacggtggtgaacaatggatacatgcaggcggcagtgcatccggaacggtgattaaccagtctggctaccagaccattaaacatggcgggcaggcaaccggaaccatcgtcaacaccggtgcagaaggtggtccggagtctgaaaatgtgtccagcggtcagatggtcggagggacggctgaatccaccaccatcaacaaaaatggccggcaggttatctggtcttcggggatggcacgggacaccctcatttacgccggcggtgaccagacggtacacggcgaggcacataacacccggctggagggaggaaaccagtatgtgcacaaatacggacttgcgctgaacacggtaattaacgaggggggctggcaggtgattaaggaaggaggaactaccgcgcataccaccatcaaccagaaaggaaagctgcaggtgaatgccggcggtaaagcgtctgatgtcacccagaacacgggaggtgcactggttaccagcacagctgcaaccgtcaccggcacaaaccgcctgggagcattctccgttctggcgggtaaggctgataatgtcgtactggaaaatggcggacgtctggatgtgctgagcggacacacagccactaatacccgtgtggatgatggcggaacgctggatgtccgcaacggtggtgccgccaccaccgtatccatggggaatggcggtgtactgctggccgattccggggccgctgtcagtggtacccggagcgacggaacggcattccgtatcgggggcggtcaggcggatgccctgatgctggaaaaaggcagttcattcacgctgaacgccggtgatacggccacggataccacggtaaatggcggactgttcactgccagagggggctcgctggcgggcaccaccacgctgaataacggtgccacgcttaccctttccgggaaaacggtgaataacgataccctgaccatccgtgaaggtgatgcactcctgcagggaggcgctcttaccggtaacggcagggtggaaaaatcaggaagtggcacactcactgtcagcaacaccacactcacccagaaaaccgtcaacctgaatgaaggcacgctgacgctgaacgacagtaccgtcaccacggatgtcatcgctcagcgcggcacggccctgaagctgaccggcagcacagtgctgaacggtgccattgaccccacgaatgtcaccctgacatccggtgccacctggaatatccctgataacgccacggtgcagtcggtggtggatgacctcagccatgccggacagattcatttcacctccacccgcacagggaagttcgtaccggcaaccctgcaggtgaaaaacctgaacgggcagaatggcaccatcagcctgcgtgtacgcccggatatggcgcagaacaatgctgacagactggtcattgacggtggcagggcaaccggaaaaaccatcctgaatctggtgaacgccggcaacagtggtacggggctggcgaccaccggtaagggtattcaggtggttgaggccattaacggtgccaccacggaggaaggggcttttgtccaggggaatatgctgcaggccggggcctttaactacaccctcaaccgggacagtgatgagagctggtatctgcgcagtgaagaacgttatcgtgctgaagtccccctgtacgcctccatgctgacacaggcaatggactatgaccggattctggcaggctcacgcagccatcagaccggtgtaaacggtgaaaataacagcgtccgtctcagcattcagggcggccatctcggtcacgataacaacggcggtattgcccgtggggccacgccggaaagcagcggcagctatggcttcgtccgtctggagggtgacctgctcagaacagaggtcgccggtatgtcactgacgacaggagtgtatggtgctgcaggccattcttccgttgatgttaaggatgatgacggctcccgcgccggcacggtccgggatgatgccggcagcctgggcggatatatgaacctgacacacacctcctccggcctgtgggctgacattgtggcacagggaacccgccacagtatgaaagcgtcatcgggcaataacgacttccgcgcacggggctggggctggctgggctcactggaaaccggtctgcccttcagtattactgacaacctgatgctggagccacggctgcagtacacctggcaggggctttcgctggatgacggtaaggacaacgccggttatgtgaagttcgggcatggcagtgcacaacatgtgcgtgccggtttccgtctgggcagccacaacgatatgacctttggtgaaggcacctcatcccgtgcccccctgcgtgacagtgcaaaacacagtgtgcgtgaactgccggtgaactggtgggtacagccttccgttatccgcaccttcagctcccggggtgatatgcgtgtggggacctccaccgcaggcagcgggatgacgttctctccctcacagaatggcacttcactggatctgcaggccggactggaagcccgtgtccgggaaaatatcaccctgggcgttcaggccggttatgcccacagcgtcagcggcagcagcgctgaaggttataacagtcaggccacgctgaatgtgaccttc

SEQ ID NO: 146 - DNA, 1371 bp, Escherichia coli
atgttgcgtcgttctcttatttttctggtgttgttgagtgcgggatgtgtctcgctcgatcctcactacagtacgcctgaatccccaatcccggcgaccttgccgggagcacagggccaggggaaggcaatcagccatgactggcagcaggtgattcacgatccccgattgcagcaggtagtaaccattgcactgaacagtaaccgcgatgtgcaaaaagcgattgctgatattgactcagcacgggcgctctatgggcaaactaatgcgtcgttatttccgacggtgaatgcggccttaagttcgactcgcagtcgttcgctggcgaatggtacggtaacaactgccgaggctgacggcacggtgtccagttatacgttagatctgtttggtcgtaatcagagtttatctcgggcggcgcgggaaacctggcttgccagtgaatttacagcccagaacactcgtttaacgctgattgctgaaatcagcaccgcctggctgacactggcggccgataacagcaacctggccctggcaaaagaaacgatggccagtgcagaaaactcattgaaaattatccagcgccagcaacaggttggcacggcggcagcgacagatgtcagtgaggcgatgagtgtttatcagcaagcgcgcgccagcgttgccagctatcagacacaagtgatgcaggataaaaatgcgctgaacttactggcaggtacaacgcttgcggaaaatctgctaccgggaacactggaaagcctgccggaacaaatgataagtctggttcctgcgggagtatcatctgatgttctgctgcgtcgcccggatatccaggaagctgaacataatttgaagagcgccaatgcagatattggcgcggcgcgggctaactttttcccgacgatttcgctgactgccagtgccggtgttggcagtgacgcattgtcgtcgttgttcagccacggaatgcagatctggtcatttgcgccatcggtcacattaccgctgttcactggcggaagtaatctggcgcagcttcgttacgcagaagcacaaaagcgtgggctcattgccacctatgaaaaaaccgttcagagcgcatttaaagatgtcgctaacgcactggcgcggcggaccacgcttgaagagcaactggatgcacagcgccagtatgttaaagctgagcaacaaacggtcgatgttggcttgcgtcgctatcaggcgggtgttggtgattacctgaccgtgttgacggcgcagcgcagcttgtggagtgcacagcaggagctgctggcactgcaactgactgattttacaaaccgaatcacgctctggcagtcgctgggcggcggcatgtcatcactcaag

SEQ ID NO: 147 - DNA, 1371 bp, Escherichia coli
atgttgcgtcgttctcttatttttctggtgttgttgagtgcgggatgtgtctcgctcgatcctcactacagtacgcctgaatccccaatcccggcgaccttgccgggagcacagggccaggggaaggcaatcagccatgattggcagcaggtgatccacgatccccgattgcagcaggtagtaaccattgcactgaaccgtaaccgcgatgtgcaaaaagcgattgctgatattgactcagcacgggcgctctatgggcaaactaatgcgtcgttatttccgacggtgaatgcggccttaagttcgactcgcagtcgttcgctggcgaatggtacgggaacaactgccgaggctgacggcacggtgtccagttatacgctagatctgtttggtcgtaatcagagtttatctcgggcggcgcgggaaacctggcttgccagtgaatttacagcccagaacactcgtttaacgctgattgctgaaatcagcaccgcctggctgacactggcggccgataacagcaacctggccctggcaaaagaaacgatggccagtgcagaaaactcattgaaaattatccagcgccagcaacaggttggcacggcggcagcgacagatgtcagtgaggcgatgagtgtttatcagcaagcgcgcgccagcgttgccagctatcagacacaagtgatgcaggataaaaatgcgctgaacttactggcaggtacaacgcttgcggaaaatctgctaccgggaacactggaaagcctgccggaacaaatgataagtctggttcctgcgggagtatcatctgatgttctgctgcgtcgcccggatatccaggaagctgaacataatttgaagagcgccaatgcagatattggcgcggcgcgggctaactttttcccgacgatttcgctgactgccagtgccggtgttggcagtgacgcattgtcgtcgttgttcagccacggaatgcagatctggtcatttgcgccatcggtcacattaccgctgttcactggcggaagtaatctggcgcagcttcgttacgcagaagcacaaaagcgtgggctcattgccacctatgaaaaaaacgttcagagcgcatttaaagatgtcgctaacgcactggcgcggcggaccacgcttgaagagcaactggatgcacagcgccagtatgttaaagctgagcaacaaacggtcgatgttggcttgcgtcgctatcaggcgggtgttggtgattacctgaccgtgttgacggcgcagcgcagcttgtggagcgcacagcaggagctgctggcactgcaactgactgattttacaaaccgaatcacgctctggcagtcgctgggcggcggtatgtcatcactcaag

SEQ ID NO: 148 - DNA, 1371 bp, Escherichia coli
atgttgcgtcgttctcttatttttctggtgttgttgagtgcgggatgtgtctcgctcgatcctcactacagtacgcctgaatccccaatcccggcgaccttgccgggagcacagggccaggggaaggcaatcagccatgactggcagcaggtgatccacgatccccgattgcagcaggtagtaaccattgcactgaacagtaaccgcgatgtgcaaaaagcgattgctgatattgactcagcacgggcgctctatgggcaaactaatgcgtcgttatttccgacggtgaatgcggccttaagttcgactcgcagtcgttcgctggcgaatggtacgggaacaactgccgaggctgacggcacggtgtccagttatacgttagatctgtttggtcgtaatcagagtttatctcgggcggcgcgggaaacctggcttgccagtgaatttacagcccagagcactcgtttaacgctgattgctgaaatcagcaccgcctggctgacactggcggccgataacagcaacctggccctggcaaaagaaacgatggccagtgcagaaaactcattgaaaattatccagcgccagcaacaggttggcacggcggcagcgacagatgtcagtgaggcgatgagtgtttatcagcaagcgcgcgccagcgttgccagctatcagacacaagtgatgcaggataaaaatgcgctgaacttactggcaggtacaacgcttgcggaaaatctgctaccgggaacactggaaagcctaccggaacaaatgataagtctggttcctgcgggagtatcatctgatgttctgctgcgtcgcccggatatccaggaagcggaacataatttgaagagcgccaatgcagatattggcgcggcgcgggctaactttttcccgacgatttcgctgactgccagtgccggtgttggcagtgacgcattgtcgtcgttgttcagccacggaatgcagatctggtcatttgcgccatcggtcacattaccgctgttcactggcggaagtaatctggcgcagcttcgttacgcagaagcacaaaagcgtgggctcattgccacctatgaaaaaaccgttcagagcgcatttaaagaagtcgctaacgcactggcgcggcggaccacgcttgaagagcaactggatgcacagagccagtatgttaaagctgagcaacaaacggtcgatgttggcttgcgtcgctatcaggcgggtgttggtgattacctgaccgtgttgacggcgcagcgcagcttgtggagcgcacagcaggagctgctggcactgcaactgactgattttacaaaccgaatcacgctctggcagtcgctgggcggcggtatgtcatcactcaag

SEQ ID NO: 149 - DNA, 1371 bp, Escherichia coli
atgttgcgtcgttctcttatttttctggtgttgttgagtgcgggatgtgtctcgctcgatcctcactacagtacgcctgaatccccaatcccggcgaccttgccgggagcacagggccaggggaaggcaatcagccatgactggcagcaggtgattcacgatccccgattgcagcaggtagtaaccattgcactgaacagtaaccgcgatgtgcaaaaagcgattgctgatattgactcagcacgggcgctctatgggcaaactaatgcgtcgttatttccgacggtgaatgcggccttaagttcgactcgcagtcgttcgctggcgaatggtacgggaacaactgccgaggctgacggcacggtgtccagttatacgttagatctgtttggtcgtaatcagagtttatctcgggcggcgcgggaaacctggcttgccagtgaatttacagcccagaacactcgtttaacgctgattgctgaaatcagcaccgcctggctgacactggcggccgataacagcaacctggccctggcaaaagaaacgatggccagtgcagaaaactcattgaaaattatccagcgccagcaacaggttggcacggcggcagcgacagatgtcagtgaggcgatgagtgtttatcagcaagcgcgcgccagcgttgccagctatcagacacaagtgatgcaggataaaaatgcgctgaacttactggcaggtacaacgcttgcggaaaatctgctaccgggaacactggaaagcctgccggaacaaatgataagtctggttcctgcgggagtatcatctgatgttctgctgcgtcgcccggatatccaggaagctgaacataatttgaagagcgccaatgcagatattggcgcggcgcgggctaactttttcccgacgatttcgctgactgccagtgccggtgttggcagtgacgcattgtcgtcgttgttcagccacggaatgcagatctggtcatttgcgccatcggtcacattaccgctgttcactggcggaagtaatctggcgcagcttcgttacgcagaagcacaaaagcgtgggctcattgccacctatgaaaaaaccgttcagagcgcatttaaagatgtcgctaacgcactggcgcggcggaccacgcttgaagagcaactggatgcacagcgccagtatgttaaagctgagcaacaaacggtcgatgttggcttgcgtcgctatcaggcgggtgttggtgattacctgaccgtgttgacggcgcagcgcagcttgtggagtgcacagcaggagctgctggcactgcaactgactgattttacaaaccgaatcacgctctggcagtcgctgggcggcggcatgtcatcactcaag

SEQ ID NO: 150 - DNA, 1371 bp, Escherichia coli
atgttgcgtcgttctcttatttttctggtgctgttgagtgcgggatgtgtctcgctcgatccccactacagcacgcctgaatccccaatcccggcgaccttgccgggagcacagggccagggaaaggcaatcagccatgactggcagcaggtgatccacgatccccgattgcagcaggtggtgactattgcactgaacagtaaccgcgatgtgcaaaaagcgattgctgatattgactcagcacgggcgctctatgggcaaactaatgcgtcgttattcccgacggtgaatgcggccttaagttcaacccgcagtcgttcgctggcgaatggtacggaaaccactgccgaggctgacggcacggtgtccagttttacgttagatctgtttggtcgtaatcagagtttatctcgggcggcgcgagaaacctggcttgccagtgaatttacagcccagaacacccgtttaacgctgattgctgaaatcagcaccgcctggctgacactggcggccgataacagcaacctggccctggcaaaagaaacgatgaccagtgcagaaaactcattgaaaattatccagcgccagcaacaggttggcacggcggcagcgacagatgtcagtgaggcgatgagtgtttatcagcaagcgcgcgccagcgttgccagctatcagacacaagtgatgcaggataaaaatgcgctgaacttactggcaggtacaacgcttgaggaaaatttgctaccgggaacactggaaagcctgccggaacagatgataagtctggttcctgcgggagtgtcatctgacgttctgctgcgtcgcccggatatccaggaagcggaacataatttgaagagcgccaatgccgatattggcgcggcgcgggctaactttttcccgacgatttcgctgactgccagcgctggtgttggcagtgacgcattgtcgtcgttgttcagccacggaatgcagatctggtcatttacgccatcggtcacattaccgctgttcactggcggaagtaatctggcgcagcttcgttacgcagaagcacaaaagcgtggactcattgccacctatgaaaaaaccgttcagagagcatttaaagatgtcgctaacgcactggcgcggcggaccacgcttgaagagcaactggatgcacagcgccagtatgttaaagctgagcaacaaacggtcgatgttggcttgcgtcgctatcagacgggtgttggtgattacctgaccgtgttgacggcgcagcgcagcttgtggagcgcacagcaggagctgctggcactgcaactgactgattttacaaaccgaatcacgctctggcagtcgctgggcggcggcatgtcatcactcaag

SEQ ID NO: 151 - DNA, 1371 bp, Escherichia coli
atgttgcgtcgttctcttatttttctggtgttgttgagtgcgggatgtgtctcgctcgatcctcactacagtacgcctgaatccccaatcccggcgaccttgccgggagcacagggccaggggaaggcaatcagccatgactggcagcaggtgattcacgatccccgattgcagcaggtagtaaccattgcactgaacagtaaccgcgatgtgcaaaaagcgattgctgatattgactcagcacgggcgctctatgggcaaactaatgcgtcgttatttccgacggtgaatgcggccttaagttcgactcgcagtcgttcgctagcgaatggtacgggaacaactgccgaggctgacggcacggtgtccagttatacgttagatctgtttggtcgtaatcagagtttatctcgggcggcgcgggaaacctggcttgccagtgaatttacagcccagaacactcgtttaacgctgattgctgaaatcagcaccgcctggctgacactggcggccgataacagcaacctggccctggcaaaagaaacgatggccagtgcagaaaactcattgaaaattatccagcgccagcaacaggttggcacggcggcagcgacagatgtcagtgaggcgatgagtgtttatcagcaagcgcgcgccagcgttgccagctatcagacacaagtgatgcaggataaaaatgcgctgaacttactggcaggtacaacgcttgcggaaaatctgctaccgggaacactggaaagcctgccggaacaaatgataagtctggttcctgcgggagtatcatctgatgttctgctgcgtcgcccggatatccaggaagctgaacataatttgaagagcgccaatgcagatattggcgcggcgcgggctaactttttcccgacgatttcgctgactgccagtgccggtgttggcagtgacgcattgtcgtcgttgttcagccacggaatgcagatctggtcatttgcgccatcggtcacattaccgctgttcactggcggaagtaatctggcgcagcttcgttacgcagaagcacaaaagcgtgggctcattgccacctatgaaaaaaccgttcagagcgcatttaaagatgtcgctaacgcactggcgcggcggaccacgcttgaagagcaactggatgcacagcgccagtatgttaaagctgagcaacaaacggtcgatgttggcttgcgtcgctatcaggcgggtgttggtgattacctgaccgtgttgacggcgcagcgcagcttgtggagtgcacagcaggagctgctggcactgcaactgactgattttacaaaccgaatcacgctctggcagtcgctgggcggcggcatgtcatcactcaag

SEQ ID NO: 152 - DNA, 1371 bp, Escherichia coli
atgttgcgtcgttctcttatttttctggtgttgttgagtgcgggatgtgtctcgctcgatcctcactacagtacgcctgaatccccaatcccggcgaccttgccgggagcacagggccaggggaaggcaatcagccatgactggcagcaggtgattcacgatccccgattgcagcaggtagtaaccattgcactgaacagtaaccgcgatgtgcaaaaagcgattgctgatattgactcagcacgggcgctctatgggcaaactaatgcgtcgttatttccgacggtgaatgcggccttaagttcgactcgcagtcgttcgctggcgaatggtacgggaacaactgccgaggctgacggcacggtgtccagttatacgttagatctgtttggtcgtaatcagagtttatctcgggcggcgcgggaaacctggcttgccagtgaatttacagcccagaacactcgtttaacgctgattgctgaaatcagcaccgcctggctgacactggcggctgataacagcaacctggccctggcaaaagaaacgatggccagtgcagaaaactcattgaaaattatccagcgccagcaacaggttggcacggcggcagcgacagatgtcagtgaggcgatgagtgtttatcagcaagcgcgcgccagcgttgccagctatcagacacaagtgatgcaggataaaaatgcgctgaacttactggcaggtacaacgcttgcggaaaatctgctaccgggaacactggaaagcctgccggaacaaatgataagtctggttcctgcgggagtatcatctgatgttctgctgcgtcgcccggatatccaggaagcggaacataatttgaagagcgccaatgccgatattggcgcggcacgggctaactttttcccgacgatttcgctgactgccagtgccggtgttggcagtgacgcgttgtcgtcgttgttcagccacggaatgcagatctggtcatttgcgccatcggtcacattaccgctgtttactggcggaagtaatctggcgcagcttcgttacgcagaagcacaaaagcgtggactcattgccacctatgaaaaaaccgttcagagcgcatttaaagatgtcgctaacgcactggcgcggcggaccacgcttgaagagcaactggatgcacagcgccagtatgttaaagctgaacaacaaacggtcgatgttggcttgcgtcgctatcaggcgggtgttggtgattacctgaccgtgttgacggcgcagcgcagcttgtggagcgcacagcaggagctgctggcactgcaactgactgattttacaaaccgaatcacgctctggcagtcgctgggcggcggcatgtcatcactcaag

SEQ ID NO: 153 - DNA, 975 bp, Escherichia coli
atgatcaccttaccaccaaaacgcggaatggcactggtcgtggtgctggtattgctggcggttatgatgctggtgaccatcacgctttccgggcgaatgcagcaacaacttgggcgaacgcgcagccagcaggagtaccagcaggcgctgtggtacagcgccagtgcggaaagcctggcgttgagcgcactcagtctgagcctgaaaaatgaaaagcgcgtgcatctggcgcagccgtgggcttccggccctcgttttttcccactgccgcaggggcaaatcgccgtcactctgcgtgacgcacaggcctgctttaacctgaatgctctcgctcagccgacgacggcgtcgcgtccgctcgcggtacaacaactgattgccctgatcacgcgcctgggtgtgcctgcttatcgggccgaactgatagccgaaagcctgtgggagtttattgacgaagaccgcagcgtgcagacgcgtctgggccgtgaagacagcgagtatctcgcccgttcggtgccgttttacgccgctaatcaaccgctggctgatatcagcgagatgcgcgtggtgcagggaatggacgccggactttatcaaaaactgaaaccgctggtctgtgcgctgccgatgacccgccagcaaatcaacatcaacaccctggacgtcacgcaaagcgtgattcttgaggcgctgtttgacccgtggttaagccctgtacaggcgcgggcgttattacaacaacgtccggcgaagggctgggaagatgtcgatcagtttcttgcacagccgctactcgctgacgtcgatgagcgtactaaaaaacagctaaaaaccgtcctgagcgtggacagcaattacttctggctgcgttcagatatcaccgtgaatgagattgaactgacgatgaattcgttaattgtccgcatgggctcacaacacttttctgttatctggcatcagacaggagaaagtgag

SEQ ID NO: 154 - DNA, 975 bp, Escherichia coli
atgatcaccttaccaccaaaacgcggaatggcactggtcgtggtgctggtattgctggcggttatgatgctggtgaccatcacgctttccgggcggatgcagcaacaacttgggcgaacgcgcagccagcaggagtaccagcaggcgctgtggtacagcgccagtgcagaaagcctggcgttgagcgcactcagtctgagcctgaaaaatgaaaagcgtgtgcatctggcacagccgtgggcttctggcccgcgttttttcccactgccgcaggggcaaattgccgtcaccctgcgtgacgcccaggcctgctttaacctgaatgccctcgctcagccgacaacggcgtcgcgtcctatcgcggtacaacaactgattgccctgatctcgcgcctggatgtgcctgcttatcgggccgaactgatagccgaaagcctgtgggagtttattgacgaggaccgcagcgtgcagacgcgtctggggcgtgaagacagcgagtatctcgcccgctcggtgccgttctacgccgctaatcaaccgctggcggatatcagcgaaatgcgcgtggtacagggaatggacgccgggctttatcaaaaactgaaaccgctggtctgtgcgctgccgatggcccgccagcaaatcaacatcaatacattagatgtcacgcaaagtgtgattcttgaggcgctgtttgacccgtggttaagccctgttcaggcgcgggcgttattacaacaacgtccggcgaagggctgggaagatgtcgatcagtttcttgctcagccgctacttgcagacgtcgatgagcgtactaaaaaacagctaaaaaccgtcctgagcgtggacagcaattacttctggctgcgttcagatatcaccgtgaatgagattgaactgacgatgaattcgttaattgtccgcatgggcccacaacacttttctgttctctggcatcagacaggagaaagtgag

SEQ ID NO: 155 - DNA, 975 bp, Escherichia coli
atgatcacctcaccaccaaaacgcggaatggcactggtcgtggtgctggtattgctggcagttatgatgctggtaaccatcacgctttccgggcggatgcagcagcaacttgggcgaacgcgcagccagcaggagtaccagcaggcgctgtggtacagcgccagtgcagaaagcctggcgctgagtgcactcagtctgagcctgaaaaatgaaaagcgcgtgcatctggcacaaccgtggacttctggccctcgttttttcccactgccgcaggggcaaatcgccgtcactctgcgtgacgcacaggcctgctttaacctgaatgccctcgctcagcccacaacggcgtcacgtccgctcgcggtacaacaactgattgccctgatctcgcgcctcgatgtgcctgcttatcgggccgaactgatagccgaaagcctgtgggagtttattgacgaggaccgcagcgtgcagacgcgtctgggccgtgaagacagcgagtatctcgcccgctcggtgccgttctacgccgccaatcaaccgctggccgatatcagcgagatgcgcgtggtgcagggaatggacgccgggctttatcaaaaactgaaaccgctggtctgtgcgctgccgatgacccgccagcaaatcaacatcaataccttagacgtcacgcaaagtgtgattcttgaggcgctgtttgacccgtggttaagccctgttcaggcgcgggcgttattacaacaacgtccggcgaagggctgggaagatgtcgatcagtttcttgcacagccgctacttgctgacgtcgatgagcgtactaaaaaacagctaaaaactgtcctgagcgtggacagcaattacttctggctgcgttcagatatcaccgtgaatgagattgaactgacgatgaactcgttaattgtccgcatgggcccacaacacttttcggttctctggcatcagacaggagaaagtgag

SEQ ID NO: 156 - DNA, 975 bp, Escherichia coli
atgatcacctcaccaccaaaacgcggaatggcactggtcgtggtgctggtattgctggcagttatgatgctggtaaccatcacgctttccgggcggatgcagcagcaactgggaagaacgcgcagccagcaggagtaccagcaggcgctgtggtacagcgccagtgcagaaagcctggcgctgagcgcgctcagtctgagcctgaaaaatgaaaagcgcgtgcatctggaacagccgtgggcttccggccctcgttttttcccactgccgcaggggcaaatcgccgtcactctgcgtgacgcacaggcctgctttaacctgaatgccctcgctcagcccacaacggcgtcgcgtccgctcgcggtacaacaactgattgccctgatcacgcgcctggatgtgcctgcttatcgggccgaactgatagccgaaagcctgtgggagtttattgatgaagaccgcagcgtgcagacgcgtctgggccgtgaagacagcgaatatctcgcccgctcggtgcctttctacgccgccaatcaaccgctggccgatatcagcgagatgcgcgtggtgcagggaatggacgccgggctttatcaaaaactgaaaccgctggtctgtgcgctgccgatgacccgccagcaaatcaacatcaatactttagacgtcacgcaaagtgtgattcttgaggcgctgtttgacccgtggttaagccctgttcaggcgcgggcgttattacaacaacgtccggcgaagggctgggaagatgtcgatcagtttcttgcacagccgctacttgctgacgtcgatgagcgtactaaaaaacagctaaaaaccgtcctgagcgtggacagcaattacttctggctgcgttcagatatcaccgtgaatgagattgaactgacgatgaactcgttaattgtccgcatgggcccacaacacttttcggttctctggcatcagacaggagaaagtgag

SEQ ID NO: 157 - DNA, 975 bp, Escherichia coli
atgatcacctcaccaccaaaacgcggaatggcactggtcgtggtgctggtattgctggcggttatgatgctggtaaccatcacgctttccgggcggatgcagcaacaacttgggcgaacgcgcagccagcaggagtaccagcaggcgctgtggtacagcgccagtgcggaaagcctggcgctgagcgcgctcagtctgagcctgaaaaatgaaaagcgcgtgcatctgacacagccgtgggcatccggccctcgtttcttccctctgccgcaggggcaaattgcggtcaccctgcgtgacgcacaggcttgctttaacctgaatgcccttgctcagccgacaacggcgtcgcgtccgcttgcggtacaacagttgattgccctgatctcgcgcctggatgtgcctgcttatcgggccgaactgatagccgaaagcctgtgggagtttattgacgaggaccgcagcgtccagacacgtctgggccgtgaagacagcgagtatctcgcccgttcggtgcctttctacgccgcgaatcaaccgctggccgatatcagcgagatgcgcgtggtgcagggaatggacgacgggctttatcaaaaactgaaaccgctggtctgtgcgctgccgatgacccgccagcaaatcaacatcaataccttagacgtcacgcaaagtgtgcttcttgaggcgctgtttgacccgtggttaagccctgttcaggcgcgggcattattacaacaacgtccggcgaagggctgggaagatgtcgatcagtttcttgcacagccgctacttgctgacgtcgatgagcgtactaaaaaacagctaaaaaccgtcctgagcgtggacagcaattacttctggctgcgttcagatatcaccgtgaatgagattgaactgacgatgaattcgttaattgtccgcatgggcccacaacacttttcggttctctggcatcagacaggagaaagtgag

SEQ ID NO: 158 - DNA, 975 bp, Escherichia coli
atgatcacctcaccaccaaaacgcggaatggcactggtcgtggtgctggtattgctggcggttatgatgctggtgaccatcacgctttccagtcggatgcagcagcaacttgggcgaacgcgcagccagcaggagtaccagcaggcgctgtggtacagcgccagtgcagaaagcctggcgctgagcgcactcagtctgagcctgaaaaatgaaaagcgtgtgcatctggcacaaccgtgggcttctggcccgcgttttttcccactgccgcaggggcaaatcgccgtcactctgcgtgacgcacaggcctgctttaacctgaatgccctcgctcagccgacgacggcgtcgcgtccgctcgcggtacaacaactgattgccctgatctcgcgccttgatgtacctgcttatcgggccgaactgatagccgaaagcctgtgggagtttattgacgaagaccgcagcgtgcagacgcgtctgggtcgtgaagacagcgagtatctcgcccgctcggtgccgttctacgccgctaatcaaccgctggctgatatcagcgagatgcgcgtggtgcagggaatggacgccgggctttatcaaaaactgaaaccgttggtctgtgcgctgccgatggcccgccagcaaatcaacatcaatacattagatgtcacgcaaagtgtgattcttgaggcgctgtttgacccgtggttaagccctgttcaggcgcgggcgttattacaacaacgtccggcgaagggctgggaagatgtcgatcagtttcttgctcagccgctacttgcagacgtcgatgagcgtactaaaaaacagctaaaaaccatcctgagcgtggacagcaattacttctggctgcgttcagatatcaccgtgaatgagattgaactgacgatgaattcgttaattgtccgcatgggcccacaacacttttctgttctctggcatcagacaggagaaagtgag

SEQ ID NO: 159 - DNA, 975 bp, Escherichia coli
atgatcacctcaccaccaaaacgcggaatggcactggtcgtggtgctggtattgctggcagttatgatgctggtaatcatcacgctttccgggcggatgcagcagcaactgggaagaacgcgcagccagcaggagtaccagcaggcgctgtggtacagcgccagtgcagaaagcctggcgctgagcgcgctcagtctgagcctgaaaaatgaaaagcgcgtgcatctggaacagccgtgggcatccggccctcgtttcttccctctgccgcaggggcaaattgcggtcaccctgcgtgacgcacaggcttgctttaacctgaatgcccttgctcagccgacaacggcgtcgcgtccgcttgcggtacaacagttgattgccctgatctcgcgcctggatgtgcctgcttatcgggccgaactgatagccgaaagcctgtgggagtttattgacgaggaccgcagcgtgcagacacgtctgggccgtgaagacagcgagtatctcgcccgttcggtgcctttctacgccgcgaatcaaccgctggctgatatcagtgagatgcgcgtggtgcagggaatggacgccgggctttatcaaaaactgaaaccgctggtctgtgcgctgccgatgacccgccagcaaatcaacatcaatactttagacgtcacgcaaagtgtgattcttgaggcgctgtttgacccgtggttaagccctgttcaggcgcgggcgttattacaacaacgtccggcgaagggctgggaagatgtcgatcagtttcttgcacagccgctacttgctgacgtcgatgagcgtactaaaaaacagctaaaaaccgtcctgagcgtggacagcaattacttctggctgcgttcagatatcaccgtgaatgagattgaactgacgatgaactcgttaattgtccgcatgggcccacaacacttttcggttctctggcatcagacaggagaaagtgag

SEQ ID NO: 160 - DNA, 975 bp, Escherichia coli
atgatcacctcaccaccaaaacgcggaatggcactggtcgtggtgctggtattgctggcggtcataatgctggtaaccatcacactttccgggcggatgcagcaacaacttgggcgaacgcgcagccagcaggagtaccaactggcgctgtggtacagcgccagtgcagaaagcctggcgctgagcgcactcagtctgagcctgaaaaatgaaaagcgtgtgcatctggcacaaccgtgggcttctggcccgcgttttttcccactgccgcaggggcaaatcgccgtcactctgcgtgacgcacaggcctgctttaacctgaatgccctcgctcagccgacgacggcgtcgcgtccgctcgcggtacaacaactgatttccctgatctcgcgcctcgatgtgcctgcttatcgggccgaactgatagccgaaagcctgtgggagtttattgacgaagaccgcagcgtgcagacgcgtctgggtcgtgaagacagcgagtatctcgcccgctcggtgccgttctacgccgctaatcaaccgctggctgatatcagcgagatgcgcgtggtgcagggaatggacgccgggctttatcaaaaactgaaaccgttggtctgtgcgctgccgatggcccgccagcaaatcaacatcaatacattagatgtcacgcaaagtgtgattcttgaggcgctgtttgacccgtggttaagccctgttcaggcgcgggcattattacaacaacgtccggcgaagggctgggaagatgtcgatcagtttcttgctcagccgctacttgcagacgtcgatgagcgtactaaaaaacagctaaaaaccatcctgagcgtggacagcaattacttctggctgcgttcagatatcaccgtgaatgagattgaactgacgatgaattcgttaattatccgcatgggcccacaacacttttctgttctctggcatcagacaggagaaagtgag

SEQ ID NO: 161 - DNA, 975 bp, Escherichia coli
atgatcacctcaccaccaaaacgcggaatggcactggtcgtggtgctggtattgctggcggttatgatgctggtaaccatcacgctttccgggcggatgcagcaacaacttgggcgaacgcgcagccagcaggagtaccagcaggcgctgtggtacagcgccagtgcggaaagcctggcgctgagcgcgctcagtctgagcctgaaaaatgaaaagcgcgtgcatctggcacagccgtgggcatccggccctcgtttcttccctctgccgcaagggcaaattgcggtcaccctgcgtgacgcacaggcttgctttaacctgaatgcccttgctcagccgacaacggcgtcgcgtccgcttgcggtacaacagttgattgccctgatctcgcgcctggatgtgcctgcttatcgggccgaactgatagccgaaagcctgtgggagtttattgacgaggaccgcagcgtgcagacgcgtctgggccgtgaagacagtgagtatctcgcccgttcggtgcctttctacgccgcgaatcaaccgctggctgatatcagtgagatgcgcgtggtgcagggaatggacgccgggctttatcaaaaactgaaaccgctggtctgtgcgctgccgatgacccgccagcaaatcaacatcaatactttagacgtcacgcaaagtgtgattcttgaggcgctgtttgacccgtggttaagccctgttcaggcgcgggcgttattacaacaacgtccggcgaagggctgggaagatgtcgatcagtttcttgcacagccgctacttgctgacgtcgatgagcgtactaaaaaacagctaaaaaccgtcctgagcgtggacagcaattacttctggctgcgttcagatatcaccgtgaatgagattgaactgacgatgaactcgttaattgtccgcatgggcccacaacacttttcggttctctggcatcagacaggagaaagtgag

SEQ ID NO: 162 - DNA, 975 bp, Escherichia coli
atgatcacctcaccaccaaaacgcggaatggcactggtcgtggtgctggtattgctggcagttatgatgctggtaaccatcacgctttccgggcggatgcagcagcaacttgggcgaacgcgcagccagcaggagtaccagcaggcgctgtggtacagcgccagtgcagaaagcctggcgctgagcgcgctcagtctgagcctgaaaaatgaaaagcgcgtgcatctggaacagccgtgggcttccggccctcgttttttcccactgccgcaggggcaaatcgccgtcactctgcgtgacgcacaggcctgctttaacctgaatgccctcgctcagcccacaacggcgtcgcgtccgctcgcggtacaacaactgattgccctgatcacgcgcctggatgtgcctgcttatcgggccgaactgatagccgaaagcctgtgggagtttattgatgaagaccgcagcgtgcagacgcgtctgggccgtgaagacagcgaatatctcgcccgctcggtgcctttctacgccgccaatcaaccgctggccgatatcagcgagatgcgcgtggtgcagggaatggacgccgggctttatcaaaaactgaaaccgctggtctgtgcgctgccgatgacccgccagcaaatcaacatcaatactttagacgtcacgcaaagtgtgattcttgaggcgctgtttgacccgtggttaagccctgttcaggcgcgggcgttattacaacaacgtccggcgaagggctgggaagatgtcgatcagtttcttgcacagccgctacttgctgacgtcgatgagcgtactaaaaaacagctaaaaaccgtcctgagcgtggacagcaattacttctggctgcgttcagatatcaccgtgaatgagattgaactgacgatgaactcgttaattgtccgcatgggcccacaacacttttcggttctctggcatcagacaggagaaagtgag

SEQ ID NO: 163 - DNA, 975 bp, Escherichia coli
atgatcacctcaccaccaaaacgcggaatggcactggtcgtggtgctggtattgctggcggttatgatgctggtgaccatcacgctttccgggcggatgcagcaacaacttgggcgaacgcgcagccagcaggagtaccagcaggcgctgtggtacagcgccagtgcagaaagcctggcgctgagcgcgctcagtctgagcctgaaaaatgaaaagcgtgtgcatctggcacaaccgtgggcttctggcccgcgttttttcccactgccgcaggggcaaattgccgtcactctgcgtgacgcacaggcctgctttaacctgaatgccctcgctcagccgacgacggcgtcgcgtccgctcgcggtacaacaactgattgccctgatctcgcgcctcgatgtgcctgcttatcgggccgaactgatagccgaaagcctgtgggagtttattgacgaagaccgcagcgtgcagacgcgtctgggtcgtgaagacagcgagtatctcgcccgctcggtgccgttctacgccgctaatcaaccgctggctgatatcagcgagatgcgcgtggtgcagggaatggacgccgggctttatcaaaaactgaaaccgttggtctgtgcgctgccgatggcccgccagcaaatcaacatcaatacattagatgtcacgcaaagtgtgattcttgaggcgctgtttgacccgtggttaagccctgttcaggcgcgggcattattacaacaacgtccggcgaagggctgggaagatgtcgatcagtttcttgctcagccgctacttgcagacgtcgatgagcgtactaaaaaacagctaaaaaccatcctgagcgtggacagcaattacttctggctgcgttcagatatcaccgtgaatgagattgaactgacgatgaattcgttaattgtccgcatgggcccacaacacttttctgttctctggcatcagacaggagaaagtgag

SEQ ID NO: 164 - DNA, 975 bp, Escherichia coli
atgatcatctcaccaccaaaacgcggaatggcactggccgtggtgctggtattgctggcggtaatgatgctggtaactatcacgctttccgcgcggatgcagcaacaacttgggcgaacgcgcagccagcaggagtaccagcaggcgctgtggtacagcgccagtgcagaaagcctggcgttgagcgctctcagtctgagcctgaaaaatgaaaagcgcgtgcatctggcacagccgtgggcttctggccctcgttttttcccactgccgcaggggcaaatcgccgtcactctgcgtgacgcacaggcctgctttaacctgaatgctctcgctcagccgacgacggcgacgcgtccgcttgcggtgcaacagttgattgccctgatcacgcgtctcgatgtgcctgcttatcgggccgaattgatagctgaaagcctgtgggagtttattgacgaggaccgcagcatacagacacgtctgggccgtgaagacagcgagtatctcgcccgttcggtgccgttctacgctgccaatcagccgctggccgatatcagcgaaatgcgcgtggtacagggaatggacgccgggctttatcaaaaactgaaaccgttggtctgtgcgctgccgatggcccgccagcaaatcaacatcaatacattagatgttacgcaaagtgtgattcttgaggcgctgtttgacccgtggttaagccctgttcaggcgcgggcattattacaacaacgtccggcgaagggctgggaagatgtcgatcagtttcttgctcagccgctacttgcagacgtcgatgatcgtactaaaaaacagctaaaaaccgtcctgagcgtggacagcaattacttctggctgcgttcagatatcaccgtgaatgagattgaactgacgatgaattcgttaattgtccgcatgggcccacaacacttttctgttctctggcatcagacaggagaaagtgag

SEQ ID NO: 165 - DNA, 975 bp, Escherichia coli
atgatcaccttgccaccaaaacgcggaatggcactggtcgtggtgctggtattgctggcggttatgatgctggtgaccatcacgctttccgggcggatgcagcaacaacttgggcgaacgcgcagccagcaggagtaccagcaggcgctgtggtacagcgccagtgcagaaagcctggcgctgagcgcgctcagtctgagcctgaaaaatgaaaagcgtgtgcatctggcacaaccgtgggcttctggcccgcgttttttcccactgccgcaggggcaaattgccgtcactctgcgtgacgcacaggcctgctttaacctgaatgccctcgctcagccgacgacgacgtcgcgtccgctcgcggtacaacaactgattgccctgatctcgcgcctcgatgtgcctgcttatcgggccgaactgatagccgaaagcctgtgggagtttattgacgaagaccgcagtgtgcagacgcgtctgggtcgtgaagacagcgagtatctcgcccgctcggtgccgttctacgccgctaatcaaccgctggctgatatcagcgagatgcgcgtggtgcagggaatggacgctgggctttatcaaaaactgaaaccgctggtctgtgcgctgccgatggcccgccagcaaatcaacatcaatacattagatgtcacgcaaagtgtgattcttgaggcgctgtttgacccgtggttaagccctgttcaggcgcgggcgttattacaacaacgtccggcgaagggctgggaagatgtcgatcagtttcttgctcagccgctacttgcagacgtcgatgagcgtactaaaaaacagctaaaaaccatcctgagcgtggacagcaattacttctggctgcgttcagatatcaccgtgaatgagattgaactgacgatgaattcgttaattgtccgcatgggcccacaacacttttctgttctctggcatcagacaggagaaagtgag

SEQ ID NO: 166 - DNA, 567 bp, Escherichia coli
atgctggtggcaattgccatttttgccttgctggcactgatggcgcagcaggtgactaacggcgtcacacgcgtgaatagcgccgtcgccggacacgatcaaaaactaaacctcatgcagcaaacgatgagttttctgacccacgatctgacacaaatgatgccgcgtccggtaagaggcgatcagggccagcgtgaaccagcgttactggcgggcgctggcgttctggcgtctgagagtggaggaatgcgttttgtgcgcggcggtgtggttaacctgttgatgcgtctgccacgcagcaatctgctcaccgtcggttaccgcattcatggtggttatctcgaacggttagcctggccactgaccgatgcggcaggcagcgtgaagccaacaacgcaaaaattaatcccggcggattcgctccgtttgcagttccacgacggcacgcgctggcaggagagctggtcatcagtgcaggcgattcctgtggcagtacgcataaccctgcattcgccgcaatggggcgaaattgaacgcatctggttgttacgcgggccgcaattatca

SEQ ID NO: 167 - DNA, 567 bp, Escherichia coli
atgctggtggcgatagccatttttgcctcactggcactgatggcgcaacaggtgacaaacggcgttacacgcgtgaatagcgccgtcgccggacacgatcaaaaactaaacctcatgcagcaaacgatgagttttttgaaccacgatctgacacaaatgatgccgcgtccggtaagaggcgatcagggccagcgtgaaccagcgttactggcgggcgctggcgtgctggcgtctgagagtgaagggatgcgttttgtacgtggcggcgtggttaatccgttgatgcgtctgccgcgcagtaatctgctcaccgtcggttaccgcattcatggtggttatctcgaacggttagcctggccactgaccgatgcggcaggcagcgtgaagccaacaacgcaaaaattaatcccggcggattcgctccgtttgcagttctacgacggcacgcgctggcaggagagctggtcatcagtgcaggcggttcctgtggcagtacgcataaccctgcattcgccgcaatggggcgaaattgaacgcatctggttgttacgcgggccgcaattatca

SEQ ID NO: 168 - DNA, 567 bp, Escherichia coli
atgctggtggcaattgccatttttgcctcgctggcactgatggcgcagcaggtgactaacggcgtcacgcgcgtgaatagcgccgtcgccggacacgatcaaaaactaaacctcatgcagcaaacgatgagttttctgacccacgatctgacccaaatgatgccgcgtccggtaagaggcgatcagggccagcgtgaaccagcgttactggctggcgctggcgtgctggcgtctgagagtgaaggaatgcgttttgtgcgcggcggtgtggttaacccgttgatgcgtatgccacgcagcaatctgctcaccgtcggttaccgcattcatgacggttatctcgaacggttgtcctggccgctgaccgatgccgcaggcagcgtgaagccgacaatgcaaaagttgattccggccgattcgctccatttgcagttctacgacggcacgcgctggcaggagagctggtcgtcagtacaggcgatccctgtggcagtgcgcatgactctgcattcgccgcaatggggcgagattgaacgcatctggttgttacgcgggccgcaattatca

SEQ ID NO: 169 - DNA, 561 bp, Escherichia coli
atgttggtggcaattgccatttttgcctcgctggcactgatggcgcagcaggtgactaacggcgtcacgcgcgtgaatagcgccgtcgccggacacgatcaaaaactaaacctcatgcagcaaacgatgagttttctgacccacgatctgacccaaatgatgccgcgtccggtaagaggcgatcagggccagcgtgaaccagcgttactggctggcgctggcgtgctggcgtctgagagtgaaggaatgcgttttgtgcgcggcggtgtggttaacccgttgatgcgtctgccgcgcagtaatctgctcaccgtcggttaccgcattcatgacggttatctcgaacggttagcctggccgctgaccgatgccgcaggcagcgtgaagccgacaatgcaaaagttgattccggccgattcgctccgtttgcagttctacgacggcacgcgctggcaggagagctggtcgtcagtacaggcgatccctgtggcggtacgcatgaccctgcattcgccgcaatggggcgagattgaacgcatctggttgttacgcgggccgcaa

SEQ ID NO: 170 - DNA, 567 bp, Escherichia coli
atgttggtggcaattgccatttttgcctcgctggcactgatggcgcagcaggtgacaaacggtgtcacacgcgtgaataacgccgtcgccggacatgatcaaaaactaaacctcatgcagcaaacgatgagttttctgacccacgatctgacacaaatgatgccgcgtccggtaagaggcgaacagggccagcgtgaaccagcgttactggcgggcgctggcgtgctggcgtctgagagtgaaggcatgcgctttgtgcgcggcggcgtggttaacccgttgatgcgtctgccacgcagcaatctgctcaccgtcggttaccgcattcatgacggttatctcgaacggttagcctggccgctgaccgatgccgcaggcagcgtgaagccgacaatgcaaaagttgattccggcggattcgctccgtttgcagttctatgatggtacgcgctggcaggagagctggtcgtcagtacaggcgatccctgtggcagtgcgcatgactctgcattcgccgcaatggggcgagattgaacgcatctggttgttacgcgggccgcaattatca

SEQ ID NO: 171 - DNA, 567 bp, Escherichia coli
atgctggtggcgatagccatttttgcctcactggcactgatggcgcagcaggtgacaaacggcgttacacgcgtgaatagcgccgtcgccggacacgatcaaaaactaaacctcatgcagcaaacgatgagttttttgaaccacgatctgacacaaatgatgccgcgtccggtaagaggcgatcagggccagcgtgaaccagcgttactggcgggcgctggcgtgctggcgtctgagagtgaaggaatacgctttgtgcgcggcggcgtggtcaatccgttgatgcgtctgccgcgcagtaatctgctcaccgtcggttaccgcattcatggtggttatctcgaacggttagcctggccactgactgatgcggcaggcagcgtgaagccaacaacgcaaaaattaatcccggcggattcgctccgtttgcagttccacgacggcacgtgctggcaggagagctggtcatcagtgcaggcgattcctgtggcagtacgcataaccctgcattcgccgcaatggggcgaaattgaacgcatctggttgttacgcgggccgcaattatca

SEQ ID NO: 172 - DNA, 567 bp, Escherichia coli
atgctggtggcgatagccatttttgcctcactggcactgatggcgcagcaggtgacaaacggcgttacacgcgtgaatagcgccgtcgccggacacgatcaaaaactaaacctcatgcagcaaacgatgagttttttgaaccacgatctgacccaaatgatgccgcgtccggtaagaggcgatcagggccagcgtgaaccagcgttactggcgggcgctggcgtgctggcgtctgagagtgaagggatgcgttttgtacgtggcggcgtggttaatccgttgatgcgtctgccgcgcagtaatctgctcaccgtcggttaccgcattcatggtggttatctcgaacggttagcctggccactgaccgatgcggcaggcagcgtgaagccaacaacgcaaaaattaatcccggcggattcgctccgtttgcagttccacgacggcacgcgctggcaggagagctggtcatcagtgcaggcgattcctgtggcagtacgcataaccctgcattcgccgcaatggggcgaaattgaacgcatctggttgttacgcgggccgcaattatca

SEQ ID NO: 173 - DNA, 561 bp, Escherichia coli
atgttggtggcaattgccatttttgcctcgctggcactgatggcgcagcaggtgactaacggcgtcacgcgcgtgaatagcgccgtcgccgatcacgatcaaaaactaaacctcatgcagcaaacgatgagttttctgacccacgatctgacccaaatgatgccgcgtccggtaagaggcgatcagggccagcgtgaaccagctttactggctggcgctggcgtgctggcgtctgagagtgaaggaatgcgttttgtgcgcggcggtgtggttaacccgttgatgcgtctgccgcgcagtaatctgctcaccgtcggttaccgcattcatgacggttatctcgaacggttagcctggccgctgaccgatgccgcaggcagcgtgaagccgacaatgcaaaagttgattccggccgattcgctccgtttgcagttctacgacggcacgcgctggcaggagagctggtcgtcagtacaggcgatccctgtggcggtacgcatgaccctgcattcgccgcaatggggcgagattgaacgcatctggttgttacgcgggccgcaa

SEQ ID NO: 174 - DNA, 567 bp, Escherichia coli
atgctggtggcgatagccatttttgcctcactggcactgatggcgcagcaggtgacaaacggcgttacacgcgtgaatagcgccgtcgccggacacgatcaaaaactaaacctcatgcagcaaacgatgagttttctgacccacgatctgacacaaatgatgccgcgtccggtaagaggcgatcagggccagcgtgaaccagcgttactggcgggcgctggcgttctggtgtctgagagtggaggaatgcgttttgtgcgcggcggtgtggttaacccgttgatgcgtctgccacgcagcaatctgctcaccgtcggttaccgcattcatgacggttatctcgaacggttagcctggccactgaccgatgcggcaggcagcgtgaagccaacaacgcaaaaattaatcccggcggattcgctccgtttgcagttctacgacggcacgcgctggcaggagagctggtcatcagtgcaggcgattcctgtggcagtacgcataaccctgcattcgccacaatggggcgaaattgaacgcatctggttgttacgcgggccgcaattatca

SEQ ID NO: 175 - DNA, 567 bp, Escherichia coli
atgctggtggcaattgccatttttgcctcgctggcactgatggcgcagcaggtgacaaacggcgtcacgcgcgtgaatagcgccatcggggaacacgatcaaaaactaaacctcatgcagcaaacgatgagttttctgacccacgatctgacacaaatgatgccgcgtccggtaaggggcgatcagggccagcgtgaacctgcgttactggcgggccctggcgtgctggcatctgagagtgaaggaatgcgctttgtacgcggcggcgtggttaatccgttgatgcgtctgccgcgcagtaatctgctcaccgtcggttaccgcattcatggtggttatctcgaacggttagcctggccactgaccgatgcggcagacagcgtgaagccaacaacacaaaaattaatcccggcggattcgctccgtttgcagttctacgacggcacacgctggcaggagagctggtcgtcagtgcaggcgatccctgtggcggtgcgcatgaccctacattcgccgcaatggggcgagattgaacgcatctggttgttacgcgggccgcaattatca

SEQ ID NO: 176 - DNA, 567 bp, Escherichia coli
atgctggtggcgatagccatttttgcctcactggcactgatggcgcagcaggtgacaaacggcgttactcgcgtgaatagcgccgtcgccggacacgatcaaaaactaaacctcatgcagcaaacgatgagttttttgaaccacgatctgacacaaatgatgccgcgtccggtaagaggcgatcagggccagcgtgaaccagcgttactggcgggcgctggcgtgctggcgtctgagagtgaagggatgcgttttgtacgtggtggcgtggttaatccgttgatgcgtctgccgcgcagtaatctgctcaccgtcggttaccgcattcatggtggttatctcgaacggttagcctggccactgaccgatgcggcaggcagcgtgaagccaacaacgcaaaaattaatcccggcggattcgctccgtttgcagttccacgacggcacgcgctggcaggagagctggtcatcagtgcaggcgattcctgtggcagtacgcataaccctgcattcgccgcaatggggcgaaattgaacgcatctggttgttacgcgggccgcaattatca

SEQ ID NO: 177 - DNA, 2139 bp, Escherichia coli
atggctaagttcacaccttcattctcaggaatcaaaggtcgggcgctcttttcactgctctttgcagcaccaatgattcatgcaaccgacactgcaacgaccaaagatggcgaaacaatcactgttacagcggatgcaaataccgcaactgaggcgaccgatggttatcaacctctgagcacttccacggcgacattaaccgatatgccgatgctggatatcccgcaggtggtcaatacggttagcgatcaggttctggaaaatcagaatgcgacgacgctggatgaagcgctttataacgtcagtaacgtggtacagaccaatacattaggcggaactcaggacgcctttgtacgtcgtgggtttggtgctaaccgggatggctccatcatgaccaacggcctgcgaactgtacttcctcgcagtttcaacgccgccacagaacgtgtggaagtgctaaaaggtccggcctccacgctgtatggcattctcgatcctggtggattgattaacgtcgtgaccaagcgcccggaaaaaacattccatggttctgtctcagccacgtcctccagttttggcggaggcactgggcaacttgatatcacaggtcccattgaaggcactcagctggcataccgcctgacgggggaagtgcaggatgaagattactggcgaaacttcggtaaagagcgcagtacatttattgccccgtcactcacctggtttggtgataatgcaacagtaactatgctctattcccatcgggactataaaactccgttcgatcgtggaacgattttcgaccttacgacgaaacagcccgtaaacgttgatcgaaaaatacgttttgacgaaccgtttaatattacagatggtcagtccgatctggcgcaactcaacgcagaatatcatctcaatagccagtggacagcgcgctttgattacagctacagccaggataaatacagcgataatcaggcgcgtgttaccgcgtatgatgcaacgacaggaacactgacacggcgtgttgatgcaactcagggatctacccagcgtatgcatgctactcgtgcggatctgcaagggaatgttgatattgccggattctataatgagattctgggtggggtgtcatatgaatattatgatcttctgcgtacagatatgattcgctgtaaaaaagctaaagatttcaatatctacaaccctgtttatggtaataccagcaaatgtacaacggtttcggcgtcggacagtgatcagacgatcaaacaggagagctactcagcgtatgcacaggacgcactctatctgaccgataactggattgccgtcgccgggatccgctatcagtattacacgcagtatgcgggtaaaggccgtccttttaatgtcaatactgacagccgcgatgaacaatggactcccaaactggggttggtctacaaactgacgccatcggtatccttatttgccaattattcgcaaacatttatgccgcagtcgtcaattgccagctacattggcgatcttccaccggaatcatctaatgcttacgaagtcggggcaaaattcgagctattcgatggtatcaccgcagatattgcgctgtttgatatccataaacgtaatgtgttgtataccgaaagtgttggtgatgaaaccattgccaaaacggcaggccgtgttcgttcaagaggggtagaagtcgaccttgcgggagcattaactgaaaacattaatatcattgccagctacggctataccgatgctaaggttctggaggatcctgattatgcagggaaaccattgccgaatgttcctcgtcataccggttcgctattcctgacctatgacattcataacatgccaggcaataacacactgacgtttggcggtggtggacatggcgtaagccgtcgttcggcaaccaatggggctgactattatctgccaggctatttcgttgccgatgccttcgctgcatacaaaatgaaattgcagtatccggtcacactgcaattaaacgtcaaaaacctgtttgataaaacgtattacacctcttccatcgccacaaataatctgggcaaccagattggcgatcctcgtgaagtgcaattcacggtgaaaatggaattt

SEQ ID NO: 178 - DNA, 2139 bp, Escherichia coli
atggctatgttcacaccttcattctcaggactcaaaggtcgggcgctcttttcactgctttttgcggcaccgatgattcatgcaacagactctgtaacgaccaaagatggcgaaacaatcactgttacagcagatgcaaataccgcaactgaggcaaccgatggttatcaacctctgagcacctccacagcgacattaaccgatatgccgatgctggatatcccgcaggtggtcaatacggttagcgatcaggttctggaaaaccagaatgcgacaacgctggatgaggcgctttataacgtcagtaacgtggtacagaccaatacattaggcgggactcaggatgcttttgtacgccgtgggtttggcgcaaaccgggatggctccatcatgaccaacggtctgcgaaccgtacttcctcgtagtttcaacgccgcaacagagcgtgtggaagtgctaaaaggcccggcctccacgctgtatggcattctcgatcctggcggactgattaacgtcgtgaccaagcgcccggaaaaaacattccatggttcggtttcagccacctcctccagttttggtggcggcactgggcaacttgatatcacaggtcccattgaaggcactcagctggcgtatcgtcttaccggggaagtgcaggatgaagattactggcgaaacttcggtaaagagcgcagtacatttattgccccgtcactcacctggtttggtgataatgcaacagtaaccatgctctattcccatcgggactataaaactccgttcgatcgtggaacgattttcgaccttacgacgaaacagcccgtaaacgttgatcgaaaaatacgttttgacgaaccgtttaatattacagatggtcagtccgatctggcgcaactcaacgcagaatatcatctcaatagccagtggacagcgcgctttgattacagctacagccaggataaatacagcgataatcaggcgcgtgttaccgcgtatgatgcaacgacaggaacactgacacggcgtgttgatgcaactcagggatctacccagcgtatgcatgctactcgtgcggatctgcaagggaatgttgatattgccggattctataatgagattctgggtggggtgtcatatgaatattatgatcttctgcgtacagatatgattcgctgtaaaaaagctaaagatttcaatatctacaaccctgtttatggtaataccagcaaatgtacaacggtttcggcgtcggacagcgatcagacgatcaaacaggagagctactcagcgtatgcacaggacgcactctatctgaccgataactggattgccgtcgccgggatccgctatcagtattacacgcagtatgcgggtaaaggccgtccttttaatgtcaatactgacagccgcgatgaacaatggactcccaaactggggttggtctacaaactgacgccatcggtatccttatttgccaattattcgcaaacatttatgccgcagtcgtcaattgccagctacattggcgatcttccaccagaatcatctaatgcttacgaagtcggggcaaaattcgagctattcgatggtatcaccgcagatattgcgctgtttgatatccataaacgtaatgtgttgtataccgaaagtgttggtgatgaaaccatcgccaaaacggcaggccgcgttcgttcaagaggggtagaagtcgaccttgcgggagcattaactgaaaacattaatatcattgccagctacggctataccgatgctaaggttctggaagatcctgattatgcaggtaaaccattgccgaatgttcctcgtcataccggttcgctattcctgacctatgacattcataacatgcctggcaataacacactgacgtttggcggtggtggacatggcgtaagccgtcgttcggcaaccaatggggctgactattatctgccaggctatttcgttgccgatgccttcgccgcatacaaaatgaaattgcagtatccggtcacactgcaattaaacgtcaaaaacctgtttgataaaacgtattacacctcttccatcgccacaaataatctgggcaaccagattggcgatcctcgtgaagtgcaattcacggtgaaaatggaattt

SEQ ID NO: 179 - DNA, 2139 bp, Escherichia coli
atggctaagttcacaccttcattctcaggaatcaaaggtcgggcgctcttttcactgctctttgcagcaccaatgattcatgcaaccgacactgcaacgaccaaagatggcgaaacaatcactgttacagcggatgcaaataccgcaactgaggcgaccgatggttatcaacctctgagcacttccacggcgacattaaccgatatgccgatgctggatatcccgcaggtggtcaatacggttagcgatcaggttctggaaaatcagaatgcaacgacgctggatgaagcgctttataacgtcagtaacgtggtacagaccaatacattaggcggaactcaggacgcctttgtacgtcgtggttttggtgctaaccgggatggctccatcatgaccaacggcctgcgaactgtacttcctcgcagtttcaacgccgccacagaacgtgtggaagtgctaaaaggtccggcctccacgctgtatggcattctcgatcctggtggattgattaacgtcgtgaccaagcgcccggaaaaaacattccatggttctgtctcagccacgtcctccagttttggcggaggcactgggcaacttgatatcacaggtcccattgaaggcactcagctggcataccgcctgacgggggaagtgcaggatgaagattactggcgaaacttcggtaaagagcgcagtacatttattgccccgtcactcacctggtttggtgataatgcaacagtaaccatgctctattcccatcgggactataaaactccgttcgatcgtggaacgattttcgaccttacgacgaaacagcccgtaaacgttgatcgaaaaatacgttttgacgaaccgtttaatattacagatggtcagtccgatctggcgcaactcaacgcagaatatcatctcaatagccagtggacagcgcgctttgattacagctacagccaggataaatacagcgacaatcaggctcgcgttaccgcgtatgatgcaacgacaggaacgctgacacggcgtgttgatgcaactcagggatctacccagcgtatgcattctactcgtgcggatctgcaagggaatgttgatattgctgggttctataatgagattctgggtggggtgtcatatgaatattatgatcttctgcgcacagatatgattcgctgtaaaaacgctaaagatttcaatatctacaaccccgtttatggcaataccagcaaatgcacaacggtttcggcgtcggacagtgatcagacgatcaaacaggagagctactcagcttatgcacaggatgcgctctatctgaccgataactggattgccgtcgccgggatccgctatcagtattacacgcagtatgcgggtaaaggccgtccttttaatgtcaatactgacagccgcgatgaacaatggacgcccaaactggggttagtctacaaactgacgccatcggtatccttatttgctaattattcgcaaacatttatgccgcaatcgtcaattgccagctacatcggagatcttccaccggaatcatctaatgcttacgaagtcggggcaaaattcgagctgttcgatggtataaccgcagatattgcgctgtttgatatccataaacgtaacgtgttgtataccgaaagtattggtgatgaaaccatcgccaaaacggcaggccgcgttcgttcaagaggggtagaagtcgaccttgcgggagcattaactgaaaacattaatatcattgccagctacggctataccgatgctaaggttctggaagatcctgattatgcagggaaaccattgccgaatgttcctcgtcataccggttcgytattcctgacctatgacattcataacatgccaggcaataacacactgacgtttggcggtggtggacattgcgtaagccgtcgttcggcaaccaatggggctgactattatctgccaggctatttcgttgccgatgccttcgccgcatacaaaatgaaattgcagtatccggtcacactgcaattaaacgtcaaaaacctgtttgataaaacgtattacacctcttccatcgccacaaataatctggggaatcagattggcgatccgcgtgaagtgcaattcacggtgaaaatggaattt

SEQ ID NO: 180 - DNA, 2139 bp, Escherichia coli
atggctatgttcacaccttcattctcaggactcaaaggtcgggcgctcttttcactgctttttgcggcaccgatgattcatgcaacagactctgtaacgaccaaagatggcgaaacaatcactgttacagcagatgcaaataccgcaactgaggcaaccgatggttatcaacctctgagcacctccacggcgacattaaccgatatgccgatgctggatatcccgcaggtggtcaatacggttagcgatcaggttctggaaaaccagaatgcgacaacgctggatgaggcgctttataacgtcagtaacgtggtacagaccaatacattaggcgggactcaggatgcttttgtacgccgtgggtttggcgcaaaccgggatggctccatcatgaccaacggtctgcgaaccgtacttcctcgtagtttcaacgccgcaacagagcgtgtggaagtgctaaaaggcccggcctccacgctgtatggcattctcgatcctggcggactgattaacgtcgtgaccaagcgcccggaaaaaacattccatggttcggtttcagccacctcctccagttttggtggcggcactgggcaacttgatatcacaggtcccattgaaggcactcagctggcgtatcgccttaccggggaagtgcaggatgaagattactggcgaaacttcggtaaagagcgcagtacatttattgccccgtcactcacctggtttggtgataatgcaacagtaaccatgctctattcccatcgggactataaaactccattcgatcgtggaacgattttcgaccttacgacgaaacagcccgtaaacgttgatcgaaaaatacgttttgacgaaccgtttaatattacagatggtcagtccgatctggcgcaactcaacgcagaatatcatctcaatagccagtggacagcgcgctttgattacagctacagccaggataaatacagcgataatcaggcgcgtgttaccgcgtatgatgcaacgacaggaacactgacacggcgtgttgatgcaactcagggatctacccagcgtatgcatgctactcgtgcggatctgcaagggaatgttgatattgccggattctataatgagattctgggtggggtgtcatatgaatattatgatcttctgcgtacagatatgattcgctgtaaaaaagctaaagatttcaatatatacaaccctgtttatggtaataccagcaaatgtacaacggtttcggcgtcggacagtgatcagacgatcaaacaggagagctactcagcgtatgcacaggacgcactctatctgaccgataactggattgccgtcgccgggatccgctatcagtattacacgcagtatgcgggtaaaggccgtccttttaatgtcaatactgacagccgcgatgaacaatggactcccaaactggggttggtctacaaactgacgccatcggtatccttatttgccaattattcgcaaacatttatgccgcagtcgtcaattgccagctacattggcgatcttccaccagaatcatctaatgcttacgaagtcggggcaaaattcgagctattcgatggtatcaccgcagatattgcgctgtttgatatccataaacgtaatgtgttgtataccgaaagtgttggtgatgaaaccattgccaaaacggcaggccgtgttcgttcaagaggggtagaagtcgaccttgcgggagcattaactgaaaacattaatatcattgccagctacggctataccgatgctaaggttctggaagatcctgattatgcaggtaaaccattgccgaatattcctcgtcataccggttcgctattcctgacctatgacattcataacatgcctggcaataacacactgacgtttggcggtggtggacatggcgtaagccgtcgttcggcaaccaatggggctgactattatctgccaggctattttgttgccgatgccttcgccgcatacaaaatgaaattgcagtatccggtcacactgcaattaaacgtcaaaaacctgtttgataaaacgtattacacctcttccatcgccacaaataatctggggaatcagattggcgatccgcgtgaagtgcaattcacggtgaaaatggaattt

SEQ ID NO: 181 - DNA, 2139 bp, Escherichia coli
atggctatgttcacaccttcattctcaggactcaaaggtcgggcgctcttttcactgctttttgcggcaccgatgattcatgcaacagactctgtaacgaccaaagatggcgaaacaatcactgttacagcagatgcaaataccgcaactgaggcaaccgatggttatcaacctctgagcacctccacggcgacattaaccgatatgccgatgctggatatcccgcaggtggtcaatacggttagcgatcaggttctggaaaaccagaatgcgacaacgctggatgaggcgctttataacgtcagtaacgtggtacagaccaatacattaggcgggactcaggatgcttttgtacgccgtgggtttggcgcaaaccgggatggctccatcatgaccaacggtctgcgaaccgtacttcctcgtagtttcaacgccgcaacagagcgtgtggaagtgctaaaaggcccggcctccacgctgtatggcattctcgatcctggcggactgattaacgtcgtgaccaagcgcccggaaaaaacattccatggttcggtttcagccacctcctccagttttggtggcggcactgggcaacttgatatcacaggtcccattgaaggcactcagctggcgtatcgccttaccggggaagtgcaggatgaagattactggcgaaacttcggtaaagagcgcagtacatttattgccccgtcactcacctggtttggtgataatgcaacagtaaccatgctctattcccatcgggactataaaactccattcgatcgtggaacgattttcgaccttacgacgaaacagcccgtaaacgttgatcgaaaaatacgttttgacgaaccgtttaatattacagatggtcagtccgatctggcgcaactcaacgcagaatatcatctcaatagccagtggacagcgcgctttgattacagctacagccaggataaatacagcgataatcaggcgcgtgttaccgcgtatgatgcaacgacaggaacactgacacggcgtgttgatgcaactcagggatctacccagcgtatgcatgctactcgtgcggatctgcaagggaatgttgatattgccggattctataatgagattctgggtggggtgtcatatgaatattatgatcttctgcgtacagatatgattcgctgtaaaaaagctaaagatttcaatatatacaaccctgtttatggtaataccagcaaatgtacaacggtttcggcgtcggacagcgatcagacgatcaaacaggagaactactcagcttatgcacaggacgcgctctatctgaccgataactggattgccgtcgccgggatccgctatcagtattacacgcaatatgcgggtaaaggccgtccttttaatgtcaatactgacagccgcgatgaacaatggacgcccaaactggggttagtctacaaactgacgccatcggtatccttatttgccaattattcgcaaacatttatgccgcagtcgtcaattgccagctacattggcgatcttccaccagaatcatctaatgcttacgaagtcggggcaaaattcgagctattcgatggtatcaccgcagatattgcgctgtttgatatccataaacgtaatgtgttgtataccgaaagtattggtgatgaaaccatcgccaaaacggcaggccgcgttcgttcaagaggggtagaagtcgaccttgcgggagcattaactgaaaacattaatatcattgccagctacggctataccgatgcaaaggttctggaagatcctgattatgcagggaaaccattgccgaatgttcctcgtcataccggttcgctattcctgacctatgatattcataacatgccaggcaataacacactgacgtttggcggtggcggacatggtgtaagccgtcgttcggcaaccaatggggctgactattatctgcctggctatttcgttgccgatgccttcgccgcatacaaaatgaaattgcagtatccggtcactctgcaattaaacgtcaaaaacctgtttgataaaacgtattacacctcttccatcgccacaaataatctgggcaaccagattggcgatccgcgtgaagtgcaattcacggtgaaaatggaattt

SEQ ID NO: 182 - DNA, 2139 bp, Escherichia coli
atggctatgttcacaccttcattctcaggactcaaaggtcgggcgctcttttcactgctttttgcggcaccgatgattcatgcaacagactctgtaacgaccaaagatggcgaaacaatcactgttacagcagatgcaaataccgcaactgaggcaaccgatggttatcaacctctgagcacttccacggcgacattaaccgatatgccgatgctggatatcccgcaggtggtcaatacggttagcgatcaggttctggaaaatcagaatgcgacgacgctggatgaagcgctttataacgtcagtaacgtggtacagaccaatacattaggcggaactcaggacgcctttgtacgtcgtgggtttggtgctaaccgggatggctccatcatgaccaacggcctgcgaactgtacttcctcgcagtttcaacgccgccacagaacgtgtggaagtgctaaaaggtccggcctccacgctgtatggcattctcgatcctggtggactgattaacgtcgtgaccaagcgcccggaaaaaacattccatggttcggtttcagccacctcctccagttttggtggcggcactgggcaacttgatatcacaggtcccattgaaggcactcagctggcgtatcgccttaccggggaagtgcaggatgaagattactggcgaaacttcggtaaagagcgcagtacatttattgccccgtcactcacctggtttggtgataatgcaacagtaactatgctctattcccatcgggactataaaactccgttcgatcgtggaacgattttcgaccttacgacgaaacagcccgtaaacgttgatcgaaaaatacgttttgacgaaccgtttaatattacagatggaaagtccgatctggcgcaactcaacgcagaatatcatctcaatagccagtggacagcgcgctttgattacagctacagccaggataaatacagcgataatcaggcgcgtgttaccgcgtatgatgcaacgacaggaacactgacacggcgtgttgatgcaactcagggatctacccagcgtatgcatgctactcgtgcggatctgcaagggaatgttgatattgccggattctataatgagattctgggtggggtgtcatatgaatattatgatcttctgcgtacagatatgattcgctgtaaaaaagctaaagatttcaatatctacaaccctgtttatggtaataccagcaaatgtacaacggtttcggcgtcggacagtgatcagacgatcaaacaggagagctactcagcgtatgcacaggacgcactctatctgaccgataactggattgccgtcgccgggatccgctatcagtattacacgcagtatgcgggtaaaggccgtccttttaatgtcaatactgacagccgcgatgaacaatggactcccaaactggggttagtctacaaactgacgccatcggtatccttatttgccaattattcgcaaacatttatgccgcagtcgtcaattgccagctacattggcgatcttccaccggaatcatctaatgcttacgaagtcggggcaaaattcgagctattcgatggtatcaccgcagatattgcgctgtttgatatccataaacgtaatgtgttgtataccgaaagtgttggtgatgaaaccattgccaaaacggcaggccgtgttcgttcaagaggggtagaagtcgaccttgcgggagcattaactgaaaacattaatatcattgccagctacggctataccgatgctaaggttctggaggatcctgattatgcagggaaaccattgccgaatgttcctcgtcataccggttcgctattcctgacttatgacattcataacatgcctggcaataacacactgacgtttggcggtggtggacatggcgtaagccgtcgttcggcaaccaatggggctgactattatctgccaggctatttcgttgccgatgccttcgccgcatacaaaatgaaattgcagtatccggtcacactgcaattaaacgtcaaaaacctgtttgataaaacgtattacacctcttccatcgccacaaataatctgggcaaccagattggcgatcctcgtgaagtgcaattcacggtgaaaatggaattt

SEQ ID NO: 183 - DNA, 2139 bp, Escherichia coli
atggctaagttcacaccttcattctcaggaatcaaaggtcgggcgctcttttcactgctctttgcagcaccaatgattcatgcaaccgacactgcaacgaccaaagatggcgaaacaatcactgttacagcggatgcaaataccgcaactgaggcgaccgatggttatcaacctctgagcacttccacggcgacattaaccgatatgccgatgctggatatcccgcaggtggtcaatacggttagcgatcaggttctggaaaatcagaatgcaacgacgctggatgaagcgctttataacgtcagtaacgtggtacagaccaatacattaggcggaactcaggacgcctttgtacgtcgtggttttggtgctaaccgggatggctccatcatgaccaacggcctgcgaactgtacttcctcgcagtttcaacgccgccacagaacgtgtggaagtgctaaaaggtccggcctccacgctgtatggcattctcgatcctggtggattgattaacgtcgtgaccaagcgcccggaaaaaacattccatggttctgtctcagccacgtcctccagttttggcggaggcactgggcaacttgatatcacaggtcccattgaaggcactcagctggcataccgcctgacgggggaagtgcaggatgaagattactggcgaaacttcggtaaagagcgcagtacatttattgccccgtcactcacctggtttggtgataatgcaacagtaaccatgctctattcccatcgggactataaaactccgttcgatcgtggaacgattttcgaccttacgacgaaacagcccgtaaacgttgatcgaaaaatacgttttgacgaaccgtttaatattacagatggtcagtccgatctggcgcaactcaacgcagaatatcatctcaatagccagtggacagcgcgctttgattacagctacagccaggataaatacagcgacaatcaggctcgcgttaccgcgtatgatgcaacgacaggaacgctgacacggcgtgttgatgcaactcagggatctacccagcgtatgcattctactcgtgcggatctgcaagggaatgttgatattgctgggttctataatgagattctgggtggggtgtcatatgaatattatgatcttctgcgcacagatatgattcgctgtaaaaacgctaaagatttcaatatctacaaccccgtttatggcaataccagcaaatgcacaacggtttcggcgtcggacagtgatcagacgatcaaacaggagagctactcagcttatgcacaggatgcgctctatctgaccgataactggattgccgtcgccgggatccgctatcagtattacacgcagtatgcgggtaaaggccgtccttttaatgtcaatactgacagccgcgatgaacaatggacgcccaaactggggttagtctacaaactgacgccatcggtatccttatttgctaattattcgcaaacatttatgccgcaatcgtcaattgccagctacatcggagatcttccaccggaatcatctaatgcttacgaagtcggggcaaaattcgagctgttcgatggtataaccgcagatattgcgctgtttgatatccataaacgtaacgtgttgtataccgaaagtattggtgatgaaaccatcgccaaaacggcaggccgcgttcgttcaagaggggtagaagtcgaccttgcgggagcattaactgaaaacattaatatcattgccagctacggctataccgatgctaaggttctggaagatcctgattatgcagggaaaccattgccgaatgttcctcgtcataccggttcgctattcctgacctatgacattcataacatgccaggcaataacacactgacgtttggcggtggtggacatggcgtaagccgtcgttcggcaaccaatggggctgactattatctgccaggctatttcgttgccgatgccttcgccgcatacaaaatgaaattgcagtatccggtcacactgcaattaaacgtcaaaaacctgtttgataaaacgtattacacctcttccatcgccacaaataatctggggaatcagattggcgatccgcgtgaagtgcaattcacggtgaaaatggaattt

SEQ ID NO: 184 - DNA, 2139 bp, Escherichia coli
atggctaagttcacaccttcattctcaggaatcaaaggtcgggcgctcttttcactgctctttgcagcaccaatgattcatgcaaccgacactgcaacgaccaaagatggcgaaacaatcactgtgacagcggatgcaaataccgcaactgaggcgaccgatggttatcaacctctgagcacttccacggcgacattaaccgatatgccgatgctggatatcccgcaggtggtcaatacggttagcgatcaggttctggaaaatcagaatgcgacgacgctggatgaagcgctttataacgtcagtaacgtggtacagaccaatacattaggcggaactcaggacgcctttgtacgtcgtgggtttggtgctaaccgggatggctccatcatgaccaacggcctgcgaactgtacttcctcgcagtttcaacgccgccacagaacgtgtggaagtgctaaaaggtccggcctccacgctgtatggcattctcgatcctggtggactgattaacgtcgtgaccaagcgcccggaaaaaacattccatggttcggtttcagccacctcctccagttttggtggcggcactgggcaacttgatatcacaggtcccattgaaggcactcagctggcgtatcgccttaccggggaagtgcaggatgaagattactggcgaaacttcggtaaagagcgcagtacatttattgccccgtcactcacctggtttggtgataatgcaacagtaaccatgctctattcccatcgggactataaaactccgttcgatcgtggaacgattttcgaccttacgacgaaacagcccgtaaacgttgatcgaaaaatacgttttgacgaaccgtttaatattacagatggtcagtccgatctggcgcaactcaacgcagaatatcatctcaatagccagtggacagcgcgctttgattacagctacagccaggataaatacagcgacaatcaggctcgtgttaccgcgtatgatgcaacgacaggaacgctgacacggcgtgttgatgcaactcagggatctacccagcgtatgcattctactcgtgcggatctgcaagggaatgttgatattgctgggttctataatgagattctgggtggggtgtcatatgaatattatgatcttctgcgcacagatatgattcgctgtaaaaacgctaaagatttcaatatctacaaccccgtttatggcaataccagcaaatgcacaacggtttcggcgtcggacagtgatcagacgatcaaacaggagagctactcagcgtatgcacaggacgcgctctatctgaccgataactggattgccgtcgccgggatccgctatcagtattacacgcagtatgcgggtaaaggccgtccttttaatgtcaatactgacagccgcgatgaacaatggacgcccaaactggggttagtctacaaactgacgccatcggtatccttatttgctaattattcgcaaacatttatgccgcaatcgtcaattgccagctacatcggagatcttccaccggaatcatctaatgcttacgaagtcggggcaaaattcgagctgttcgatggtataaccgcagatattgcgctgtttgatatccataaacgtaacgtgttgtataccgaaagtattggtgatgaaaccatcgccaaaacggcaggccgcgttcgttcaagaggggtagaagtcgaccttgcgggagcattaactgaaaacattaatatcattgccagctacggctataccgatgctaaggttctggaagatcctgattatgcagggaaaccattgccgaatgttcctcgtcataccggttcgctattcctgacctatgacattcataacatgccaggcaataacacactgacgtttggcggtggtggacatggcgtaagccgtcgttcggcaaccaatggggctgactattatctgccaggctatttcgttgccgatgccttcgccgcatacaaaatgaaattgcagtatccggtcacactgcaattaaacgtcaaaaacctgtttgataaaacgtattacacctcttccatcgccacaaataatctggggaatcagattggcgatccgcgtgaagtgcaattcacggtgaaaatggaattt

SEQ ID NO: 185 - DNA, 561 bp, Escherichia coli
atgttaaaaaaaacattgttatctatgttcgcaaccgcattgttatcaggcgttgcttttaacgctcttgctgacgatgctaatcagggttcaggtaaaattacttttaaaggtgaagttatcgatgcaccttgttctattgctcctggtgatgaagatcagacaataaacctcggtgaagttgctgataccgtattaaaaagcggtcagaaatcactgcctgtagatgtcaccattcatttgcaggattgtattttatctgacggcactaacactgttgataaagtcaaaatcacctttagttctgccagtgttgacgctaccgactccaacctgcttaaaaacactctggaaggtaacatcggcggcgcaactgatgtaggcgtacgtctggtgaaatcagacaacaccaacgtgactcttggcactccaatcactatcaacttcccgacgactaactcttaccaggagttgaactttaaagcccgtatggagtctctgggacgcaccgcgaccccgggtaacgtgcaggcacaggctaattacgtactcgactacaag

SEQ ID NO: 186 - DNA, 561 bp, Escherichia coli
atgtttaaaaaaacattgttatctatgttcgcaaccgcattgttatcaggcgttgcttttaacgctcttgctgacgatgctaatcaggggtccggtaaaattacttttaaaggtgaagttatcgatgcaccttgttctattgctcctggtgatgaagatcagacaataaacctcggtgaagttgctgataccgtattaaaaagcggtcagaaatctctgcctgtagatgtcaccattcacttgcaggattgtattttatctgacggcactaatactgttgataaagtcaaaatcacctttagttctgccagtgttgacgctaccgattccaacctgcttaaaaacactctggaaggtaacatcggcggcgcaactgatgtaggcgtacgtctggtgaaatcagacaacaccaacgtgactcttggcactccaatcactatcaacttcccgacgactaactcctaccaggagttgaactttaaagcccgtatggaatctctgggacgcaccgcgaccccaggtaacgtgcaggcacaagctaattacgtactcgactacaag

SEQ ID NO: 187 - DNA, 453 bp, Escherichia coli
gtgagtttgtcaaccgcattaagaatgacctgcaggcgcaggttattatcactcatcgttggccccgcttctctgaatcgctttataccgccagtccagcacttcggtcagcggcataacgtcagtaacggatggcggccagtgaaaaatggtggcgatatctgccaccagatcgtcaaccgtcaggctgtcggtaaaccggcaagcaccgacttcttcaacaaaaaagtgacaacctcaaccgacatggcagtgagatctgccgggtccatctctgcaatttcctgcgcagtcagtgccggactggagatgcgggggatcacggtcatcatcgcgtttacatccatatccataatggcctgcaggcgtgtaccgcgcagcgcaccggactgcggtttacgcagcacaatttcggtaatttctgttttaccgcgcatgatgggggtgtccagt

SEQ ID NO: 188 - DNA, 453 bp, Escherichia coli
gtgagcttgtcaaccgcattaagaatgacctgcagacgcaggttgttatcactcatcgttggccccgcttctctgaatcgctttataccgccattccagcacttcggtcagcggcataacgtcagtaacggatggcggccagtgaaaaatggtggcgatatctgccaccagatcgtcaaccgtcaggctgtcggtaaaccggcaagcaccgacttcttcaacaaaaaagtgacaacctcaaccgacatggcagtgagatctgccgggtccatctctgcaatttcctgtgcagtcagtgccggactggagatgcgggggatcacggtcatcatcgcgtttacatccatatccataatggcctgcaggcgtgtaccgcgcagcgcaccggactgcggtttacgcagcacaatttcggtgatttctgttttaccgcgcttgatgggggtatccagt

SEQ ID NO: 189 - DNA, 453 bp, Escherichia coli
gtgagcttgtcaaccgcattaagaatgacctgcagacgcaggttgttatcactcatcgttggccccgcttctctgaatcgctttataccgccattccagcacttcggtcagcggcataacgtcagtaacggatggcggccagtgaaagatggtggcgatatctgccaccagatcgtcaaccgtcaggctgtcggtaaaccggcaagcaccgacttcttcaacaaaaaagtgacaacctcaaccgacatggcagtgagatctgccgggtccatctctgcgatttcctgtgcagtcagtgccggactggagatgcgggggatcacggtcatcatcgcgttcacatccatatccataatggcctgcaggcgtgtgccgcgcagcgcaccggactgcggtttacgcagcacaatttcggtaatttctgttttaccgcgcatgatgggagtatccagt

SEQ ID NO: 190 - DNA, 453 bp, Escherichia coli
atgattcacctgttcaaaacctgcatgattaccgccttcattctggggttaacgtggtctgccccactccgggcacaggatcaacgttacatcagtatacgcaatacagatacgatatggctcccgggaaatatttgtgcttaccagttccggctggataatggcggaaacgatgaaggatttggccccctcaccatcactctgcaactcaaagacaaatatggtcagacgctggtgaccagaaaaatggaaacggaagcttttggtgacagtaatgccacgcgaaccacagacgcatttctggaaacggagtgcgtggaaaatgtcgccacaaccgaaatcatcaaagcaactgaagaaagtaacggccatcgtgtcagtctgccgttatcggttttcaatccccaggactaccatccactgctgattaccgtttccggaaaaaacgttaac

SEQ ID NO: 191 - DNA, 453 bp, Escherichia coli
atgattcacctgttcaaaacctgcatgattaccgccttcattctggggttaacgtggtctgccccactccgggcacaggatcaacgttacatcagtatacgcaatacagatacgatatggctcccgggaaatatttgtgcttaccagttccggctggataatggcggaaacgatgaaggatttggccccctcaccatcactctgcaactcaaagacaaatatggtcagacgctggtgaccagaaaaatggaaacggaagcctttggtgacagtaatgccacgcgaaccacagacgcatttctggaaacggagtgcgtggaaaatgtcgccacaaccgaaatcattaaagcaactgaagaaagtaacggccatcgtgtcagtctgccgttatcggttttcgatccccaggactaccatccactgctgattaccgtttccggaaaaaacgttaac

SEQ ID NO: 192 - DNA, 453 bp, Escherichia coli
atgattcacctgttcaaaacctgcatgattaccaccttcattctggggttaatgtggtctgccccactccgggcacaggatcaacgttacatcagtatacgcaatacagatacgatatggctcccgggaaatatttgtgcttaccagttccggctggataatggcggaaacgatgaaggatttggccccctcaccatcactctgcaactcaaagacaaatatggtcagacgctggtgaccagaaaaatggaaacggaagcttttggtgacagtaatgccacgcgaaccacagacgcatttctggaaacggagtgcgtggaaaatgtcgccacaaccgaaatcattaaagcaactgaagaaagtaacggccatcgtgtcagtctgccgttatcggttttcgatccccaggactaccatccactgctgattaccgtttccggaaaaaacgttaac

SEQ ID NO: 193 - DNA, 453 bp, Escherichia coli
atgattcacctgttcaaaacctgcatgattaccaccttcattctggggttaatgtggtctgccccactccgggcacaggatcaacgttacatcagtatacgcaatacagatacgatatggctcccgggaaatatttgtgcttaccagttccggctggataatggcggaaacgatgaaggatttggccccctcaccatcactctgcaactcaaagacaaatatggtcagacgctggtgaccagaaaaatggaaacggaagcttttggtgacagtaatgccacgcgaaccacagacgcatttctggaaacggagtgcgtggaaaatgtcgccacaaccgaaatcatcaaagcaactgaagaaagtaacggccatcgtgtcagtctgccgttatcggttttcaatccccaggactaccatccactgctgattaccgtttccggaaaaaacgttaac

SEQ ID NO: 194 - DNA, 453 bp, Escherichia coli
atgattcacctgttcaaaacctgcatgattaccgccttcattctggggttaacgtggtctgccccactccgggcacaggatcaacgttacatcagtatacgcaatacagatacgatatggctcccgggaaatatttgtgcttaccagttccggctggataatggcggaaacgatgaagggtttggccccctcaccatcactctgcaactcaaagacaaatatggtcagacgctggtgaccagaaaaatggaaacggaagcttttggtgacagtaatgccacgcgaaccacagacgcatttctggaaacggagtgcgtggaaaatgtcgccacaaccgaaatcattaaagcaactgaagaaagtaacggccatcgtgtcagtctgccgttatcggttttcgatccccaggactaccatccactgctaattaccgtttccggaaaaaacgttaac

SEQ ID NO: 195 - DNA, 453 bp, Escherichia coli
atgattcacctgttcaaaacctgcatgattaccgccttcattctggggttaacgtggtctgccccactccgggcacaggatcaacgttacatcagtatacgcaatacagatacgatatggctcccgggaaatatttgtgcttaccagttccggctggataatggcggaaacgatgaaggatttggccccctcaccatcactctgcaactcaaagacaaatatggtcagacgctggtgaccagaaaaatggaaacggaagcttttggtgacagtaatgccacgcgaaccacagacgcatttctggaaacggagtgcgtggaaaatgtcgccacaaccgaaatcattaaagcaactgaagaaagtaacggccatcgtgtcagtctgccgttatcggttttcaatccccaggactaccatccactgctgattaccgtttccggaaaaaacgttaac

SEQ ID NO: 196 - DNA, 453 bp, Escherichia coli
atgattcacctgttcaaaacctgcatgattaccgccttcattctggggttaacgtggtctgccccactccgggcacaggatcaacgttacatcagtatacgcaatacagatacgatatggctcccgggaaatatttgtgcttaccagttccggctggataatggcggaaacgatgaaggatttggccccctcaccatcactctgcaactcaaagacaaatatggtcagacgctggtgaccagaaaaatggaaacggaagcctttggtgacagtaatgccacgcgaaccacagacgcatttctggaaacggagtgcgtggaaaatgtcgccacaaccgaaatcattaaagcaactgaagaaagtaacggccatcgtgtcagtctgccgttatcggttttcgatccccaggactaccatccactgctgattaccgtttccggaaaaaatgttaac

SEQ ID NO: 197 - DNA, 561 bp, Escherichia coli
atgaaactcaaacatgtcggtattattgtcgtttctgtgttggcgatgtcgtctgctgcggtaagcgcagccgagggtgatgaatcagtaacgaccactgttaatggcggtgtaattcattttaaaggtgaagtggtaaatgccgcttgtgcgattgattcagaatcaatgaaccaaacggttgagctgggtcaggttcgttcttctcgcctggctaaagcgggtgacctcagctccgccgttggcttcaatatcaagctgaatgattgtgataccaatgtttccagtaatgcagctgttgcattcctgggtactactgtcaccagtaatgacgatacattagcgctgcagagttcagcggcaggctctgcccaaaatgtcggtatccaaattttggaccgtacaggggaggtattagtacttgatggtgctacttttagcgctaaaactgacttgattgatggcacgaatatactgccgttccaggctcgttatattgctctcgggcagtcagtagctggtactgcaaacgctgatgcgaccttcaaagttcaatatcta

SEQ ID NO: 198 - DNA, 561 bp, Escherichia coli
atgaaactcaaacatgttggtatgattgtcgtttctgtgttggcgatgtcgtctgctgcggtaagcgcagccgagggtgatgaatcagtaacgaccactgttaatggcggtgttattcattttaaaggtgaagtggtaaatgccgcttgtgcaattgattcagaatcaatgaaccaaacggttgagctgggtcaggttcgttcttctcgcctggctaaagcgggtgacctcagctccgccgttggcttcaatatcaagctgaatgattgtgataccaatgtttccagtaatgcagctgttgcattcctgggtactactgtcaccagtaatgacgatacgttagcgctgcagagttcagcggcaggctctgcccaaaatgtcggtattcaaattttggaccgtacgggtgaggtattaatacttgatggggccacttttagtgctaaaaccgacttgattgatggcacgaatatactgccattccaggctcgttatattgctctcgggcagtccgtagctggtactgcaaacgctgatgcgaccttcaaagttcaatatcta

SEQ ID NO: 199 - DNA, 561 bp, Escherichia coli
atgaaactcaaacatgtcggtattattgtcgtttctgtgttggcgatgtcgtctgctgcggtaagcgcagccgagggtgatgaatcagtaacgaccactgttaatggcggtgtaattcattttaaaggtgaagtggtaaatgccgcttgtgcgattgattcagaatcaatgaaccaaactgttgagctgggtcaggttcgttcttctcgcctggctaaagcgggtgacctcagctccgccgttggcttcaatatcaagctgaatgattgtgataccaatgtttccagtaatgcagctgttgcattcctgggtactactgtcaccagtaatgacgatacattagcgctgcagagttcagcggcaggctctgcccaaaatgtcggtatccaaattttggacagtacaggggaggtattagtacttgatggtgctacttttagcgctaaaactgacttgattgatggcacgaatatactgccgttccaggctcgttatattgctctcgggcagtcagtagctggtactgcaaacgctgatgcgaccttcaaagttcaatatcta

SEQ ID NO: 200 - DNA, 561 bp, Escherichia coli
atgaaactcaaacatgtcggtattattgtcgtttctgtgttggcgatgtcgtctgctgcggtaagcgcagccgagggtgatgaatcagtaatgaccactgttaatggcggtgtaattcattttaaaggtgaagtggtaaatgccgcttgtgcgattgattcagaatcaatgaaccaaacggttgagctgggtcaggttcgttcttctcgcctggctaaagcgggtgacctcagctccgccgttggcttcaatatcaagctgaatgattgtgataccaatgtttccagtaatgcagctgttgcattcctgggtactactgtcaccagtaatgacgatacattagcgctgcagagttcagcggcaggctctgcccaaaatgtcggtatccaaattttggaccgtacaggggaggtattagtacttgatggtgctacttttagcgctaaaactgacttgattgatggcacgaatatactgtcgttccaggctcgttatattgctctcgggcagtcagtagctggtactgcaaacgctgatgcgaccttcaaagttcaatatcta

SEQ ID NO: 201 - DNA, 561 bp, Escherichia coli
atgaaactcaaacatgtcggtatgattgtcgtttctgtgttggcgatgtcgtctgctgcggtaagcgcagccgagggtgatgaatcagtaacgaccactgttaatggcggtgttattcattttaaaggtgaagtggtaaatgccgcttgtgcgattgattcagaatcaatgaaccaaacggttgagctgggtcaggttcgctcttctcgtctggctaaagcgggtgacctcagctccgccgttggcttcaatatcaagctgaatgattgtgataccaatgtttccagtaatgcagctgttgcattcctgggtactactgtcaccagtaatgacgataccttagcgctgcagagttcagcggcaggctctgcccaaaatgttggtattcaaattttggaccgtacgggggaggtattaatacttgatggtggcacttttagcgctaaaaccgacttgattgatggcacgaatatactgccattccaggctcgttatattgctctcgggcagtcagtagctggtactgcaaacgctgatgcgaccttcaaagttcaatatcta

SEQ ID NO: 202 - DNA, 561 bp, Escherichia coli
atgaaactcaaacatgttggtatgattgtcgtttctgtgttggcgatgtcgtctgctgcggtaagcgcagccgagggtgatgaatcagtaacgaccactgttaatggcggtgttattcattttaaaggtgaagtggtaaatgccgcttgtgcgattgattccgaatcaatgaaccaaacggttgagctgggtcaggttcgttcttctcgcctggctaaagcgggtgacctcagctccgccgttggcttcaatatcaagctgaatgattgtgataccaatgtttccagtaatgcagctgttgcattcctgggtactactgtcaccagtaatgacgatacgttagcgctgcagagttcagcggcaggctctgcccaaaatgtcggtattcaaattttggaccgtacgggtgaggtattaatacttgatggggccacttttagtgctaaaaccgacttgattgatggcacgaatatactaccattccaggctcgttatattgctctcgggcagtccgtagctggtactgcaaacgcagatgcgaccttcaaagttcaatatcta

SEQ ID NO: 203 - DNA, 561 bp, Escherichia coli
atgaaactcaaacatgtcggtatgattgtcgtttctgtgttggcgatgtcgtctgctgcggtaagcgcagccgagggtgatgaatcagtaacgaccactgttaatggcggtgttattcattttaaaggtgaagtggtaaatgccgcttgtgcgattgattcagaatcaatgaaccaaacggttgagctgggtcaggtccgttcttctcgcctggctaaagcaggtgacctcagctccgccgttggcttcaatatcaagctgaatgattgtgataccaatgtttccagtaatgcagctgttgcattcctgggtactactgtcaccagtaatgacgataccttagcgctgcagagttcagcggcaggctctgcccaaaatgtcggtattcaaattttggaccgtacgggggaggtattaatacttgatggtgccacttttagcgctaaaaccgacttgattgatggcacgaatatactgccattccaggctcgttatattgctctcgggcagtcagtagctggtactgcaaacgctgatgcgacgttcaaagttcaatatcta

SEQ ID NO: 204 - DNA, 7947 bp, Escherichia coli
atgaataaagtatataaagtcatttggaaccatacaacccaaaaatgggatgttgtttcagaattgacgagttgtagaaaaaaatgtaaatcaactcgcttaggaattgctttatcagcaatggttctggggggcgctattgcaattaattgcaataacgcaatggcagatgtcatattgtcaccagactggcgtccgggtacgaataactcgggtgttggggctgcaacagtaagtggtaaaaccgaatacatcactggtccaaatgtcgtccagtctggtgggtcaggtcttatctggatgactgtagaacaggcaattttaaatggctacaccactggagataatttatccggattgatttacgtcaataccggagaaaaaacaaaaaccattacagtgaaggatgaggttactggcgcttctcaaacacttcaagtgtttgatactgactctttctcacaacgcgatgcggggactgggggaaatgaaaccattcctggttttagtggcactgcggattttttcaatgcgacacgttttgtaacagccaataatggcggtacagctattttggatgtgggttcaccagcaatcggtaatttttttaaaaatacacagcttgctgtagctgatggagaaggttcctctgttgtatggaactcggtcaatgatttttattttcagcctggtgcaaccatgcaggggggcggcgttactcaaaaaatcattgactcaatgaaatatgctggaacaattactgattgggcgggaaaagtacaccatattaactctcttgatgatttaaagcaatataatcaatatttgataaagtcactagaggacaaaacgctttcttataagcagtatgatgctgaatttaataaggcccttattgtcaccaagcataattacaatgtggatatgaccgctgggggacgtatagactcaactccttacaaagaaaatgtagggctgcttgctgttctccatgcaaccaataacgcacgagcaatattaggtaaaacgggtaaattaactggagttcttcctgcctatgggaatggaggagggatcgttgcaactaatggtgggaccggtgttaatgaaggggtcattgatgccattggtactgaaatgattgcctatcaagacagtaccattgttaacgatggtacactttttgtttgggataataatgataaatatgctctccaggcagaggggatggttgccggtagtaatggttcttcagccattaataatggtgttattaatattcgcccatttaaaaatgctttcgctccagaggggattaacaccgcaattgttgttagtaatgggggcatggcaacaaataaaggcacaataaatattactgccgatgcatcaactaatgataataatggcaaaacacgaggtgtaaatgttggagctggaggctcttttattaactcggccttcgggagcatcaatgtaggtattgcggaggataaaactgcgactcattcggctgtgggttctgttgcgattgaagtacaaaatggtgcaaacaaagtcgttaatgaaggtactatttttttgggcaggggggctcaggggaactacggaatcctggcaaaggatgccgggactgttgatgtggtaaataaagggactatcactattgacggtcatgacagtgatgcacctgcactgaatgttggcatgctggcaaataatagctccgggatgaaaaactccgggattatcaatgttaatggtctgaacagcaccgggctacaggtaatcaatgcaggacagttgaattctgacggtacgataaatgttggcggcaagggtatcagtagtggtttccgtaactatggtgcctgggtggaaggtgccggaagcaatgttaatgtatccggaaaaatcagtcttgccggtacgggggctgtgggggtttttgctaaagatggcggcagtctgaccctgtcaggcaatggtgcagtgctatttggcagcagcgatcagataggcttttatgtctatggaaaggactctgccattcataataccggaagcggtgttatggatgtgtccactgaaaactcaacattattccgtattgccagtggtgcgacattccagggaactgcagatgcttcttctgcacttacggcgtctggtaagaactcttatgcacttattgccacggggaaatcggatggcggtgtggcctcgacagtaacgtctggaggaatgaccatcaacctgacgggtgagggggctacagcgactttaattgaagggggagcgcagggcacaattgaaagtaatgccattatcaatatggataatgccagtgcgatagccggtattgcggatggcaatggctatgatatttccggcaaactcattaatccgaaggacaagaccacactattaacggcgggggctcagttaagttccacccaggataaagtgaccgggtatatcgcccgtaatggggccactctaaataataccggtaatatcatctttactggaaagaatacagtgggcgtccgggttgaggagggggctgttggtaccaacagcggaaatattacagttcaggatggtggtgtgggactaattgctaatgccacacaagatgttacaacgattaataactcgggaaatctcgttctcaagggaggagataatgctaaccgtacaacgggtataaaagcatctggtacaacaacaacggttaatatgaccgcgggtactatatctttgcagggacagggggcgattggcgttgaggccagcaataaagggactgttaaccttgatggttcggcagtaccgaactttgctgctgacggctctggtattaccgatcagattgcttttcgtattatcggagatggtgcaaccattaagacgaatattgcaccgggaactctgctggatgccagtggggaacgttctgtacttttccgtattgaagatggggcaaaacaggccggctctctgctgatgaaaacctccgggacaggcagccgtggtatctgggccacagggaaagggagcaatgtcctggctgatgctggcagtgatttccagatcctgggcgctcaggctcagggattatatgtaactggtggtgcgacagcgacgctgaaacagggggcatcagttaaccttgtaggggatggcgctgttgtcgcggaagttgacggaaatgaatacgctctggatggcagtattacacaaacgaatactggctcggttattaccaatgaggcagatatctcttcgccgctgaataatgccaagggctttattacgcgtaatcagggactgttgattaacaacggcaacattgatttcactaccggtacagataatatcggcgtctgggttgataacggccgctttgaaaatacaggaagccgtattgcggtcaatggcgttgcattatttgttgaaggtgcacagtctcagattaccagcacaggaggggatatcgtcgctgtggatggtgaggctgccattaagctgggggcgggcgcgtcactgaacctggcagggagtggcttgggtacgatcgaaggtcagaaaaatgcgcatggcatcctgctggatacaggggctgtggggctggttattgatggtgcgaaaatcaatgttaatgctgcaggtgcggtcggtcacgggattgagaaccgcgcagaaattgaaggcattcagttaaccaatacgactgaaattaatgtggctgatggcattggtgtacgtacttctgcctccctggccaagaccaacagcggcactattaatgtagacggcagtggaattgcactggcgttccagaaagctgacggaagtgaaaccgataataacctggatatgtctgactccgctggattggtcattaacctgaagggtacggacggcacgggtattttcgccaacactaaagatggtgctgtcgtgaagagtggtgcaagtgtcaatgttatacaggccgatggcggttccgctctggtggttaacaatgcagccagtgaagtggttcagagcggtaatctcatctctgcttctctgagtcatgccgtagtggatgcttcaaaagcacaatcctttaccaataaaggtcagattaaagctgcgtccaccaccgggactgcaatggcgtttgatgacgccgtgaataccaccgtactgaatgacagcggtgctgaaattcagggggttgtggctctgaacggcggtgataacacattcaccaataaaggcagtattaccggaaccgtcagtgcgaaagagggtaacaatacatttttatttgatgatggcagcacactgacaggagaagtgactgcaggaaatggcaataataatgtaacactcaatggtaagactcatgttgatcaggttactgccggtaccgggaagaacaccttcaccattaaaggtgaaggggcaacctggaacctgctggatggcgggcagggagattctgattccctgatttttgataacgccattcatacgctggattctgttgtaaaactacagaatttcgaacatgtcgggctgaagaacagttcacttgtcactctgaaggaagctcttgtgctgaccgatggggggaacggtccgggttccgtcgatattgaatcgggcagcgaactggccattattcccgcagttgcaggcaactttacctttgatccactgttaacaggcaaaggaacactgtctgcccgtcttgatgccgacacatctgcttttgaattcagccataacgtcggggatcaatttgccggaactctgaagctgggtactagtagctttgctctggaagggctgaatacgagcgggttaacccatgcaatgctgatgtctgaaaccgggaatatcacaacggttggctccggtgttcagcagattggcggtcttgggttcaatggcggaacgctgatttttggttccgttatgccgggcgataccattgccagcaacagtattgaaacctctgctgcaggtacgctggatatccgggggaaaggcacaattcaggtcaccatgccagatgaagtgattaatgatattccggctgttgatacccgtaagaatttgctggagcaggatgatgcgcagaccctggtcacgctggtgaatgcagcgggtaccgtcaccggtactggcgggcaactgcaactggtggatgaaaacgggcaggctatttctcacagtcagacgtttgatgtcactcagggcggtgaagttgtagctcagggaaattatgactataagctgctgggaagctccgacggtattaaaggtgacggactgtacataggctatgggctgaagtcgctggatttacagggaaccggtgataaagcgctggtgctgacaccgagagcgaatgcccagggactgcagacagatcttggcgcacagttaacgggggcaggggatctggccatcgaagctgcggggcaggttgtcacactgtctaacggcggtaataactacaccggggatacgctggtgcgcagcggcacattacagatggcaaatgataatgtacttggcgcaacaggtaatctgaacgtcgccagcaatgccgtcttcagaacaaacggatacagccagactgtcggtgcactgcagacagaaacgggagcgcacattcagcttgatagcggtagtgtactaacggtcagcggcacgcagcgtcagccgggggatgataatggtggcatcattgaaaacaacgtgctgtccggtgagggaacgctggctgtcacgggcagcaatctgacggtacatggcaccaatatcgggtttaccggtaatgccagccttacccagggggcgctggttgaaatgaacggcgcacaggggctgggaagccagggctccatcagctttgaaagccttaatgatcgcctggcgattgatatcgccgacggtagcggagtcagcagtaacctgagtaaatcgctttccggagaaggttcagtgggtatactgaacaccactgatctgacgctttccggggataacagtaatttcagcggtgaattccgtgtgcagaaagatgctgctctgcgggcttcagatgaaaaacacctgggcaccgggctgattgacagtgatggtgtcacctggcttaccgccagtggaaactggttactgaagaatgatattactggctccggcgctctggtgaaacagggggcgggtaatctgatcattaatcatgagctgacttataccggtgataccacggttgagagtggcgttctgattgtcggtgatgattcagtcacccgtgccgctggcgcgacgttgtcaggatccaaaaacattcatgttcttaatggcggcacactgagtgggctggggaccgtttcgggtcaggttaataaccagggaacactggcatcactgaatgctctctcaggttatgaaacggcagaggtgggcaattttaccgttggctcactgaccaataccggcgtcattcgtctggccggtggtaagacaggaaataccctgaccgtaaatggcgattacaccggtggcggtacgttaattatcaataccgtgctgggggatgatacttctaccactgacaaactgattgtcacgggtaacacctccggtgataccggcgtggtggtgaataatgtccggggccagggggctcagaccgctgacggcattgagattgtgcatgtcggtgggcagtctgacggtaacttcagactgcagaaccgtgcggtggcaggggcgtgggaatatttcctgcataaaggtaatgcgggtggtactgacggtaactggtatctgcgttctgaattgccgccagaaccacaaccgcagccgcagccacaaccgcagccgcagccacaaccgcagccgcagccacaaccgcagccacagccacaccccacgccggataaacctgtacagaaggtctatcgtccggaagcgggctcttatattgcgaacatagcggcagccaacacgctgttcaacatcagaatgcacgatcgtgagggggaaacttactataccgatgtgtttactggtgagaagaaagcaacaagtatgtggatgcgtcatatcggcggtcataatcgctggaaggacagcagttcacagctgaatacgcaaagtaaccgttatgttgtgcaactgggtggcagcattgcgcaatggactgacggtcaggaccgtctgcaacaggggattatggccggttatggaaatgagaagagttccacgacatcctcgctttcgggatataaatctaaaggtgcgatcaatggatacagcaccggtttatacggaacgtggcagcagaatgacggtaatgacaacggggcttatgtcgatacctggatccagtacggatggtttaataataccgttaatggtgaaaaactggctgcggagtcctggaaatcccgtggatttaccggttcagtggaagcgggttatacctttaaagccggcgaatttaccggtagccagggtagtcactatgactggtatattcagccgcagtcccagatcacgtggatgaatgtaagagccagtgagcatacggagaagaatggcacgaaagttcagctcagcggagacggtaatatccagagtcgtctgggcgtcagaacttacctgaaaggtaagagtgcgtctgatgataataaggcgcatcagtttgagccatttgtggaagttaactggatccataatacacggagctggggtgtcaaaatggataatacggcactcagtcaggacggagctacaaatattgctgaagtcaaaacgggtgttcagggtaaattgtcagataacctgaatgtctggggcaatgttggtgttcaggctggcgataaagggtacagtgatgcccaggcaatgctgggtattaaatatatattc

SEQ ID NO: 205 - DNA, 7911 bp, Escherichia coli
atgaataagatatataaagtcatttggaaccatacaacccaaaaatgggatgttgtttcagaattgacgagttgtagaaaaaaatgtaaatcaactcgcttaggaattgctttatcagcaatggttctggggggcgctattgcaattaattgcaataacgcaatggcagatgtcatattgtcaccagactggcgtccgggtacgaataactcgggtgttggggctgcaacagtaagtggtaaaaccgaatacatcactggtccaaatgtcgtccagtctggtgggtcaggtcttatctggatgactgtagaacaggcaattttaaatggttacaccactggagataatttatccggattgatttacgtcaataccggagaaaaaacaaaaaccattacagtgaaggatgaggttactggcgcttatcaaacacttcaagtgtttgatactgactctttctcacaacgcgatgcggggactggaggaaatgaaaccattcctggttttagtggcactgcagattttttcaatgcgacacgttttgtaacagccaataatggcggtacagctattttggatgtgggttcaccagcaatcggtaatttttttaaaaatacacagcttgctgtagctgatggagaaggttcctctgttgtatggaactcggtcaatgatttttattttcagcctggtgcaaccatgcaggggggcggcgttactcaaaaaatcattgactcaatgaaatatgctggaacaattactgattgggcgggaaaagtacaccatattaactctcttgatgatttaaagcaatataatcaatatttgataaagtcactagaggacaaaacgctttcttataagcagtatgatgctgaatttaataaggcccttattgtcaccaagcataattacaatgtggatatgaccgctgggggacgtatagactcaactccttacaaagaaaatgtagggctgcttgctgttctccatgcaaccaataacgcacgagcaatattaggtaaaacgggtaaattaactggagttcttcctgcctatgggaatggaggagggatcgttgcaactaatggtgggaccggtgttaatgaaggggtcattgatgccattggtactgaaatgattgcctatcaagacagtaccattgttaacgatggtacactttttgtttgggataataatgataaatatgctctccaggcagaggggatggttgccggtagtaatggttcttcagccattaataatggtgttattaatattcgcccatttaaaaatgctttcgctccagaggggattaacaccgcaattgttgttagtaatgggggcatggcaacaaataaaggcacaataaatattactgccgatgcatcaactaatgataataatggcaaaacacgaggtgtaaatgttggagctggaggctcttttattaactcggccttcgggagcatcaatgtaggtattgcggaggataaaactgcgactcattcggctgtgggttctgttgcgattgaagtacaaaatggtgcaaacaaagtcgttaatgaaggtactatttttttgggcaggggggctcaggggaactacggaatcctggcaaaggatgccgggagtgttgatgtggtaaataaagggactatcactattgacggttatgacagtgatgcacctgcactgaatgttggcatgctggcaaataatagctccgggatgaaaaactccgggattatcaatgttaatggtctgaacagtaccgggctacaggtaatcaatgcagggcaattaaattctgacggtacgataaatgttggcggcgagggtatcagtagtggtttccgtaactatggtgcctgggtggaaggtgccagaagcaatgttaatgtatccggaaaaatcaatctttccggtactggtgctgtgggggtttttgccaaagatggcggcagtcttaccttgtcaggcaatggtgcagtgctatttggcagcagcgatcagataggcttttatgtctatggaaaggactctgccattcataataccggaagcggtgttatggatgtgtccactgaaaactcaacattattccgtattgccagcggtgcgacattccagggaactgcagatgcttcttctgcacttacggcgtctggtaagaactcttatgcacttattgccacggggaaatcggatggcggtgtggcctcgacagtaacgtctggaggaatgaccatcaacctgacgggggagggggctacagcgactttaattgaagggggagcgcagggcacaattgaaagtaatgccattatcaatatggataatgccagtgcaatagccggtattgcggatggcaatggctatgatatttccggcaaactcattaatccgaaggacaagaccacactattaacggcgggggctcagttaagttccacccaggataaagtgaccgggtatatcgcccgtaatggggccactctaaataataccggtaatatcatctttactggaaagaatacagtgggcgtccgggttgaggagggtgctgttggtaccaacagcggaaatattacagttcaggatggtggtgtgggactaattgctaatgccacacaagatgttacaacgattaataactcgggaaatctcgttctcaaggggggagataatgctaaccgtacaacgggtataaaagcatctggtacaacaacaacggttaatatgaccgcgggtactatatctttgcagggacagggggcgattggcgttgaggccagcaataaagggactgttaaccttgatggctcggcagtaccgaactttgcttctgacggctctggtattaccgatcagattgcttttcgtattatcggagatggtgcaaccattaagacgaatattgcaccgggaactctgctggatgccagtggggaacgttctgtacttttccgtattgaagatggggcaaaacaggccggctctttgctgatgaaaacctccgggacaggcagccgtggtatctgggccacagggaaagggagcaatgtcctggctgatgctggcagtgatttccagatcctgggcgctcaggctcagggattatatgtaactggtggtgcgacagcgacgctgaaacagggggcatcagttaaccttgtaggggatggcgctgttgtcgcggaagttgacggaaatgaatacgctctggatggcagtattacacaaacgaatactggctcggttattaccaatgaggcagatatctcttcgccgctgaataatgccaagggctttattacgcgtaatcagggactgttgattaacagcggcaacattgatttcactaccggtacagataatatcggcgtctgggttgataatggtcgttttgaaaatacaggaagccgtatagcggtcaatggcgttgcattatttgttgaaggtgaacacgctcagattaccagcacgggaggggatatcgtcgctgtggatggtgaggctgccattaagctgggggcgggcgcgtcactgaacctggcagggagtggcctgggaacgatcgaaggtcagaaaaatgcgcatggcatcctgctggatacaggggctgtggggctggttattgatggtgcgaaaatcaatgttaatgctgcaggtgcggtcggtcacgggattgagaaccgtgcagaaattgaaggcattcagttaaccaatacgactgaaattaatgtggctgatggcattggtgtgcgaacttctgcttctctggccaagaccaacagcggcactattaatgtagacggcagtggaattgcactggcgttccagaaagctgacggaagtgaaaccgataataacctggatatgtctgactccggcggattagtcattaatctgaaaggcacgggcggcacgggtattttcgccaacactaaagatggtgctgtcgtgaagagtggtgcaagtgtcaatgttacacaggccgatggcggttccgctctggtggttaacaatgcggccagtgaagtggttcagagcggtaatctcatctctgcttctctgagtcatgccgtagtggatgcttcaaaagcacagtcctttaccaataaaggtcagattaaagctgcgtccgccaccgggactgcaatggcgtttgatgacgccgtgaataccaccgtactgaatgacagcggtgctgaaattcagggggttgtggctctgaacggcggtgataacacattcaccaataaaggcagtattaccggaaccgtcagtgcaaaagagggtaacaatacatttttatttgatgatggcagcatactgacaggagaagtggctgcaggaaatggcaataacaatgtaacgctcaatggtaaggctcatgttgataaggttactgccggtaccgggaagaacaccttcaccattaaaggcgaaggggcaacctggaacctgctggatggcgggcagggagattctgattccctgatttttgataacgccattcatacgctggattctgctgtaaaactacggaattttgaacatgtcgggctgaagaacagttcgcttgtcactctgaaggaagctcttgtgctgaccgatggggggaccggcccgggttccgtcgatattgaatcgggcagcgaactggccattattcccgcagttgcaggcaactttacctttgatccactgttaacaggcaaaggaacactgtctgcccgtcttgatgccgacacatctgcttttgaattcagccataacgtcggggatcaatttgccggaactctgaagctgggtaccagtagctttgctctggaagggctgaatacgagcgggttaacccatgcaatgctgatgtctgaaaccgggaatatcacaacggttggctccggtgttcagcagattggcggtcttgggttcaatggcggaacgctgatttttggttccgttatgccgggcgataccattgccagcaacagtattgaaacctctgctgcaggtacgctggatatccgggggaaaggcacaattcaggtcaccatgccagatgaagtgattaatgatattccggctgttgatacccgtaagaatttgctggagcaggatgatgcgcagaccctggtcacactggtgaatgcagcgggtaccgtcaccggtactggcgggcaactgcaactggtggatgaaaacgggcaggctatttctcacagtcagacgtttgatgtcactcagggcggtgaagttgtagctcagggaaattatgactataagctgctgggaagctccgacggtgttaaaggtgacggactgtacataggctatgggctgaagtcgctggatttacagggaaccggtgataaagcgctggtgctgacaccgagagcgaatgcccagggactgcagacagatcttggtgcacagttaacgggggcaggggatctggccatcgaagctgcggggcaggttgtcacactgtctaacggcggtaataactacaccggggatacgctggtgcgcagcggcacactgcagatggcaaatgataatgtgcttggcgctacaggtagcctgaacgttgccagcaatgccgtcttcagaacagacggatacagccagacggtgggtgcactgcagacagaaacgggagcgcacattcagcttgatagcggtagtgtactcacggtcagcggcacgcagcgtcagccgggcgatgataatggtggcatcattgaaaacaatgtgctgaccggagacggtacgctggctgtcacgggcagcaatctgacggtacatggcaccaatatcgggttcaccggtaatgtcagccttacccggggttcgctggttgaaatgaacggcgcacaggggctgggaagccagggctccatcagctttgaaagccttaatgatcgcctggcgattgatatcgccgacggtagcggagtcagcagtaacctgagtaaatcgctttccggaaaaggttcagtgggcatactgaacaccactgatctgacactttccggagataaccgtaatttcagcggtgaattccgtgtgcagaaagatgctgctctgcgggcttcagatgaaaaacacctgggcaccgggctgattgacagtgatggtgtcacctggcttaccgccagtggaaactggttactgaagaatgatattactggctccggcgctctggtgaaacagggggcgggtaatctgatcattaatcatgagctgacttataccggtgataccacggttgagaatggcgttctgattgtcggtgatgattcagtcacccgtgccgctggcgcgacgttgtcaggatccaaaaacattcatgttcttaatggcggcacactgagtgggctggggaccgtttcgggtcaggttaataaccagggaacactggcatcactgaatgctctctcaggttatgaaacggcagaggcgggcaattttaccgttggctcactgaccaataccggcgtcattcgtctggccggtggtaagacaggaaataccctgaccgtaaatggcgattacactggtggcggtacgttaattatcaataccgtgctgggggatgatacttctgccactgacaaactgattgtcacgggtaacacctccggtgataccggcgtggtggtgaataatgtccggggccagggggctcagaccgctgacggcattgagattgtgcatgtcggtgggcagtctgacggtaacttcagactgcagaaccgtgcggtggcaggggcatgggaatatttcctgcataaaggtaatgcgggtggtactgacggtaactggtatctgcgttctgaattgccgccagaaccacaaccgcagccgcagccacaaccgcagccacagccacaccccacgccggataaacctgtacagaaggtctatcgtccggaagcgggctcttatattgcgaacatagcggcagccaacacgctgttcaacatcagaatgcacgatcgtgagggggaaacttactataccgatgtgtttactggtgagaagaaagcaacaagtatgtggatgcgtcatatcggcggtcataatcgctggaaggacagcagttcacagctgaatacgcaaagtaaccgttatgttgtgcaactgggtggcagcattgcgcaatggactgacggtcaggaccgtctgcaactggggattatggccggttatggaaatgagaagagttccacgacatcctcgctttcgggatataaatctaaaggtgcgatcaatggatacagcaccggtttatacggaacgtggcagcagaatgacggtaatgacaacggggcttatgtcgatacctggatccagtacggatggtttaataataccgttaatggtgaaaaactggctgcggagtcctggaaatcccgtggatttaccggttcagtggaagcgggttatacctttaaagccggcgaatttaccggtagccagggtagtcactatgactggtatattcagccgcagtcccagatcacgtggatgaatgtaagagccagtgagcatacggagaagaatggcacgaaagttcagctcagcggagacggtaatatccagagtcgtctgggcgtcagaacttacctgaaaggtaagagtgcgtctgatgataataaggcgcatcagttcgagccatttgtggaagttaactggatccataatacacggagctggggtgtcaaaatggataatacggcactcagtcaggacggagctacaaatattgctgaagtcaaaacgggtgttcagggtaaattgtcagataacctgaatgtctggggcaatgttggtgttcaggctggcgataaagggtacagtgatgcccaggcaatgctgggtattaaatatatattc

SEQ ID NO: 206 - DNA, 3072 bp, Escherichia coli
atgccaacaataaccactgcacaaattaaaagcacactgcagtctgcaaagcaatccgctgcaaataaattgcactcagcaggacaaagcacgaaagatgcattaaaaaaagcagcagagcaaacccgcaatgcgggaaacagactcattttacttatccctaaagattataaaggacagggttcaagccttaatgaccttgtcaggacggcagatgaactgggaattgaagtccagtatgatgaaaagaatggcacggcgattactaaacaggtattcggcacagcagagaaactcattggcctcaccgaacggggagtgactatctttgcaccacaattagacaaattactgcaaaagtatcaaaaagcgggtaataaattaggcggcagtgctgaaaatataggtgataacttaggaaaggcaggcagtgtactgtcaacgtttcaaaattttctgggtactgcactttcctcaatgaaaatagacgaactgataaagaaacaaaaatctggtagcaatgtcagttcttctgaactggcaaaagcgagtattgagctaatcaaccaactcgtggacacagctgccagcattaataataatgttaactcattttctcaacaactcaataagctgggaagtgtattatccaatacaaagcacctgaacggtgttggtaataagttacagaatttacctaaccttgataatatcggtgcagggttagatactgtatcgggtattttatctgtgatttcagcaagtttcattctgagcaatgcagatgcagataccggaactaaagctgcagcaggtgttgaattaacaacgaaagtactgggtaatgttggaaaaggtatttctcaatatattatcgcacagcgtgcagcacaggggttatctacatctgctgctgctgccggtttaattgcttctgctgtgacactggcaattagtcccctctcattcctgtccattgccgataagtttaaacgtgcaaataaaatagaggagtattcacaacgattcaaaaaacttggatacgatggtgacagtttacttgctgctttccacaaagaaacaggagctattgatgcatcattaacaacgataagcactgtactggcttcagtatcctcaggtattagtgctgctgcaacgacatctcttgttggtgcaccggtaagcgcactggtaggtgctgttacggggataatttcaggtatccttgaggcttcaaaacaggcaatgtttgaacatgtcgccagtaaaatggccgatgttattgctgaatgggagaaaaaacacggcaaaaattactttgaaaatggatatgatgcccgccatgctgcatttttagaagataactttaaaatattatctcagtataataaagagtattctgttgaaagatcagtcctcattactcagcaacattgggatacgctgataggtgagttagctggtgtcaccagaaatggagacaaaacactcagtggtaaaagttatattgactattatgaagaaggaaaacgtctggagaaaaaaccggatgaattccagaagcaagtctttgacccattgaaaggaaatattgacctttctgacagcaaatcttctacgttattgaaatttgttacaccattgttaactcccggtgaggaaattcgtgaaaggaggcagtccggaaaatatgaatatattaccgagttattagtcaagggtgttgataaatggacggtgaagggggttcaggataaggggtctgtatatgattactctaacctgattcagcatgcatcagtcggtaataaccagtatcgggaaattcgtattgagtcacacctgggagacggggatgataaggtctttttagctgccggctcagccaatatctacgcaggaaaggggcatgatgttgtttactatgataaaacagataccggttatctgaccatcgatggtacaaaagcaactgaagccggtaattacacggtaacacgtgtacttggtggcgatgttaaggttttacaggaagttgtgaaggagcaggaggtttcagttggcaaaaggactgaaaaaacacaatatcgaagctatgaattcactcatattaatggcacagacttaaccgagacagataacttatactccgtggaggagctcatcggaaccaaccgtgctgataagttttttggcagcaaatttacagatatcttccatggcgcggatggtgatgaccacatagaaggaaatgatgggaatgaccgcttatatggtgataaaggtaatgacacactgaggggcggaaacggggatgaccagctctatggcggtgatggtaacgataagctaaccggaggtgtgggtaataactaccttaatggcggagacggggatgatgagcttcaggttcagggtaattctcttgctaaaaatgtattatccggtggaaaaggtaatgacaagctgtacggcagtgagggggcagatctgcttgatggcggagaagggaatgatctcctgaagggggggtatggtaatgatatttatcgttatctttcaggatatggccatcatattattgacgatgatgggggaaaagacgataaactcagtttggctgatattgatttccgggacgttgcctttaagcgagaaggaaatgacctcatcatgtataaagctgaaggtaatgttctttccattggtcataaaaatggtattacattcaggaactggtttgaaaaagagtcaggtgatatctctaatcaccagatagagcagatttttgataaagatggccgggtcatcacaccagattcccttaaaaaagcatttgaatatcagcagagtaataatcaagccaattatgtgtatggagagtatgcatcaacttatgcagacctggataatctgaatccattaattaatgaaatcagcaaaattatttcagctgcaggtaacttcgatgttaaggaggaaagatctgccgcttctttattgcagttgtccggtaatgccagtgatttttcatatggacggaactcaataactttgaccgcatcagca

SEQ ID NO: 207 - DNA, 3072 bp, Escherichia coli
atgccaacaataaccactgcacaaattaaaagcacactgcagtctgcaaagcaatccgctgcaaataaattgcactcagcaggacaaagcacgaaagatgcattaaaaaaagcagcagagcaaacccgcaatgcgggaaacagactcattttacttatccctaaagattataaaggacagggttcaagccttaatgaccttgtcaggacggcagatgaactgggaattgaagtccagtatgatgaaaagaatggcacggcgattactaaacaggtattcggcacagcagagaaactcattggcctcaccgaacggggagtgactatctttgcaccacaattagacaaattactgcaaaagtatcaaaaagcgggtaataaattaggcggcagtgctgaaaatataggtgataacttaggaaaggcaggcagtgtactgtcaacgtttcaaaattttctgggtactgcactttcctcaatgaaaatagacgaactgataaagaaacaaaaatctggtggcaatgtcagttcttctgaactggcaaaagcgagtattgagctaatcaaccaactcgtggacacagctgccagccttaataataatgttaactcattttctcaacaactcaataagctgggaagtgtattatccaatacaaagcacctgaacggtgttggtaataagttacagaatttacctaaccttgataatatcggtgcagggttagatactgtatcgggtattttatctgcgatttcagcaagtttcattctgagcaatgcagatgcagataccggaactaaagctgcagcaggtgttgaattaacaacgaaagtactgggtaatgttggaaaaggtatttctcaatatattatcgcacagcgtgcagcacaggggttatctacatctgctgctgctgccggtttaattgcttctgttgtgacactggcaattagtccactctcattcctgtccattgccgataagtttaaacgtgccaataaaatagaggagtattcacaacgattcaaaaaacttggatacgatggtgacagtttacttgctgctttccacaaagaaacaggagctattgatgcatcgttaacaacgataagcactgttctggcttcagtatcttcaggtattagtgctgctgcaacgacatctctggttggtgcaccggtaagcgcgctggtaggggctgttacggggataatttcaggcatccttgaggcttcaaaacaggcaatgtttgaacatgtcgccagtaaaatggccgatgttattgctgaatgggagaaaaaacacggcaaaaattactttgaaaatggatatgatgcccgccatgctgcatttttagaggataactttgaaatattatctcagtataataaagagtattctgttgaaagatctgtcctcattacccagcaacattgggatacgctgataggtgagttagctggtgtcaccagaaatggagacaaaacactcagtggtaaaagttatattgactattatgaagaaggaaaacgactggagaaagaaccggatgaattccagaagcaagtctttgacccattaaaagggaatattgacctgtctgtaattaagtcatctactttgttaaagtttattacgccattattgactcctggcaaggaaattcgtgaaaggaggcagtccggaaaatacgagtatattaccgaactattagtcaagggggttgataaatggacggtgaagggggttcaggacaaggggtctgtgtatgattactctaacctgattcagcatgcatctgtcggtaataaccagtatcgggaaattcgtattgagtcacacctgggagacggggatgataaggtctttttatctgccggctcagccaatatctacgcaggaaagggacatgatgttgtttattatgataaaacagacaccggttatctgaccattgatggcacaaaagcaactgaagccggtaattacacggtaacacgtgtacttggtggcgatgttaaggttttacaggaagttgtgaaggagcaggaggtttcagttggcaaaaggactgaaaaaacacaatatcgaagctatgaattcactcatattaatggcacagacttaaccgagacagataacttatactccgtggaggagctcatcggaaccaaccgtgctgataagttttttggcagcaaatttacagatatcttccatggcgcggatggtgatgaccacatagaaggaaatgatgggaatgaccgcttatatggtgataaaggtaatgacacactgaggggcggaaacggggatgaccagctctatggcggtgatggtaacgataagctaaccggaggtgtgggtaataactaccttaatggcggagacggggatgatgagcttcaggttcagggtaattctcttgctaaaaatgtattatccggtggaaaaggtaatgacaagctgtacggcagtgagggggcagatctgcttgatggcggagaagggaatgatctcctgaagggggggtatggtaatgatatttatcgttatctttcaggatatggccatcatattattgacgatgatgggggaaaagacgataaactcagtttggctgatattgatttccgggacgttgcctttaagcgagaaggaaatgacctcatcatgtataaagctgaaggtaatgttctttccattggtcataaaaatggtattacattcaggaactggtttgaaaaagagtcaggtgatatctctaatcaccagatagagcagatttttgataaagatggccgggtcatcacaccagattcccttaaaaaagcatttgaatatcagcagagtaataatcaagccaattatgtgtatggagagtatgcatcaacttatgcagacctggataatctgaatccattaattaatgaaatcagcaaaattatttcagctgcaggtaacttcgatgttaaggaggaaagatctgccgcttctttattgcagttgtccggtaatgccagtgatttttcatatggacggaactcaataactttgaccgcatcagca

SEQ ID NO: 208 - DNA, 3072 bp, Escherichia coli
atgccaacaataaccactgcacaaattaaaagcacactacagtctgcaaagcaatcctctgcaaataaattgcactcagcaggacaaagcacgaaagatgcattaaaaaaagcagcagagcaaacccgcaatgcgggaaacagactcattttacttatccctaaagattataaaggacagggttcaagccttaatgaccttgtcaggacggcagatgaactgggaattgaagtccagtatgatgaaaagaatggcacggcgattactaaacaggtattcggcacagcagagaaactcattggcctcaccgaacggggagtgactatctttgcaccacaattagacaaattactgcaaaagtatcaaaaagcgggtaataaattaggcggcagtgctgaaaatataggtgataacttaggaaaggcaggcagtgtactgtcaacgtttcaaaattttctgggtactgcactttcctcaatgaaaatagacgaactgataaagagacaaaaatctggtagcaatgtcagttcttctgaactggcaaaagcgagtattgagctaatcaaccaactcgtggacacagctgccagcattaataataatgttaactcattttctcaacaactcaataagctgggaagtgtattatccaatacaaagcacctgaccggtgttggtaataagttacagaatttacctaaccttgataatatcggtgcagggttagatactgtatcgggtattttatctgcgatttcagcaagcttcattctgagcaatgcagatgcagataccggaactaaagctgcagcaggtgttgaattaacaacgaaagtactgggtaatgttggaaaaggtatttctcaatatattatcgcacagcgcgctgcacagggattatctacatctgctgctgctgccggtttaattgcttctgtagtgacattagcaattagtcccctctcattcctgtccattgccgataagtttaaacgtgccaataaaatagaggagtattcacaacgattcaaaaaacttggatacgatggtgacagtttacttgctgcttttcacaaagaaacaggagctattgatgcatcgttaacaacgataagcactgttctggcttcagtatcttcaggtattagtgctgctgcaacgacatctctggttggtgcaccggtaagcgcgctggtaggggctgttacggggataatttcaggcatccttgaggcttcaaaacaggcaatgtttgaacatgtcgccagtaaaatggccgatgttattgctgaatgggagaaaaaacacggcaaaaattactttgaaaatggatatgatgcccgccatgctgcatttttagaagataactttaaaatattatctcagtataataaagagtattctgttgaaagatcagtcctcattacccagcaacattgggatacgctgataggtgagttagcgggtgtcaccagaaatggagacaaaacactcagtggtaaaagttatattgactattatgaagaaggaaaacgtctggagaaaaaaccggatgaattccagaagcaagtctttgacccattgaaaggaaatattgacctttctgacagcaaatcttctacgttattgaaatttgttacgccattgttaactcccggtgaggaaattcgtgaaaggaggcagtccggaaaatatgaatatattaccgagttattagtcaagggtgttgataaatggacggtgaagggggttcaggacaaggggtctgtatatgattactctaacctgattcagcatgcatcagtcggtaataaccagtatcgggaaattcgtattgagtcacacctgggagacggggatgataaggtctttttatctgccggctcagccaatatctacgcaggtaaaggacatgatgttgtttattatgataaaacagacaccggttatctgaccattgatggcacaaaagcaaccgaagcgggtaattacacggtaacacgtgtacttggtggtgatgttaagattttacaggaagttgtgaaggagcaggaggtttcagttggaaaaagaactgaaaaaacgcaatatcggagttatgaattcactcatatcaatggtaaaaatttaacagagactgataacttatattccgtggaagaacttattgggaccacgcgtgccgacaagttttttggcagtaaatttactgatatcttccatggcgcggatggtgatgaccatatagaaggaaatgatgggaatgaccgcttatatggtgataaaggtaatgatacgctgaggggcggaaacggggatgaccagctctatggcggtgatggcaatgataagttaattggggggacaggtaataattaccttaacggcggtgacggagatgatgagcttcaggttcaggggaattctcttgctaaaaatgtattatccggtggaaaaggtaatgacaagttgtacggcagtgagggagcagatctgcttgatggcggagaagggaatgatcttctgaaaggtggatatggtaatgatatttatcgttatctttcaggatatggccatcatattattgacgatgatggggggaaagacgataaactcagtttggctgatattgatttccgggatgtggccttcaggcgagaaggtaatgacctcatcatgtataaagctgaaggtaatgttctttccattggtcataaaaatggtattacattcaggaactggtttgaaaaagagtcaggtgatatctctaatcaccagatagagcagatttttgataaagacggcagggtaatcacaccagattcccttaaaaaggcacttgagtatcaacagagtaataataaggcaagttatgtgtatgggaatgatgcattagcctatggaagtcaggataatcttaatccattaattaatgaaatcagcaaaatcatttcagctgcaggtaattttgatgttaaagaggaaagagctgcagcttctttattgcagttgtccggtaatgccagtgatttttcatatggacggaactcaataactttgacagcatcagca

SEQ ID NO: 209 - DNA, 3072 bp, Escherichia coli
atgccaacaataaccactgcacaaattaaaagcacactgcagtctgcaaagcaatccgctgaaaataaattgcactcagcaggacaaagcacgaaagatgcattaaaaaaagcagcagagaaaacccgcaatgcgggaaacagactcattttacttatccctaaagattataaaggacagggttcaagccttaatgaccttgtcaggacggcagatgaactaggaattgaagtccagtatgatgaaaagaatggcacggcgattactaaacaggtgttcggcacagcagagaaactcattggcctcaccgaacggggagtgactatctttgcaccaaaattagacaaattactgcaaaagtatcaaaaagcaggtaataaattaggtggcagtgctgaaaatatcggtgataacttaggaaaggcaggcggtatattatcaacgtttcaaaatttcctgggtactgcactttcctcaatgaaaatagacgaactgataaaaaaacaaaaatctggtggcaatgtcagttcttctgagatggcagaagcgagtattgagctaatcaatcaacttgtggatacagctgccagccttaataataatgttaactcattttctcaacaactcaatactctgggaagtgtattatccaatacaaagcacctgaacggtgttggtaataagttacagaatttacctaatcttgataatatcggtgcagggttagatactgtatcgggtattttatctacgatttcagcaagcttcattctgagcaatgcagatgcagataccagaactaaagctgcagcaggtgttgaattaacaacgaaagtactgggtaatgttggaaaaggtatttctcaatatattatcgcacagcgcgctgcacaggggttatctacatctgctgctgctgccggtttaattgcttctgctgtgatactagcaattagtcccctctcattcctgtccattgccgataagtttaaacgtgccaataaaatagaggagtattcacaacgattcaaaaaacttggatacgatggtgacagtttacttgctgctttccacaaagcaacaggggctattgatgcatcattaacaacgataagcactgtactggcttcagtatcttcaggtattagtgctgctgcaacgacatctctggttggtgcaccggtaagcgcgctggtaggcgctgttacggggataatttcaggtatccttgaggcttcaaagcaggcaatgtttgaacatgttgccagtaaaatggctgatgttattgctgaatgggagaaaaaacacggcaaaaattactttgaaaatggatatgatgcccgccatgctgcatttttagaagataactttaaaatattatctcagtataataaaaagtattctgttgaaagatcagtcctcattacccagcaacattgggatacgctgataggtgagttagctggtgtcaccagaaatggagacaaaacactcagtggtaaaagttatattgattattatgaagaaggaaaacgtctggagaaaaaaacggatgaattccagaagcaagtctttgacccattgaaaggaaacattgacctttctgacagcaaatcttctacgttattgaaatttgttacgccattattaactcccggtgaggaaattcgtgaaaggaggcagtccggaaaatatgaatatattaccgagttattagtcaagggtgttgataaatggacggtgaagggggttcaggacaagggggctgtatatgattactctaacctgattcagcatgcatcagtcggtaataaccagtatcggggaattcgtattgagtcacacctgggagacggggatgataaggtttttttatctgctggctcagccaatatctacgcaggtaaaggacatgatgttgtttattatgataaaacagacaccggttatctgaccattgatggcacaaaagcaaccgaagcgggtaattacacggtaacacgtgtacttggtggcgatgttaaggttttacaggaagttgcgaaggagcaggaggtttcagtcggaaaaagaactgaaaaaacgcaatatcggagttatgaattcactcatatcaatggtaaaaatttaacagagactgataacttatattccgtggaagaacttattgggaccacgcgtgccgacaagttttttggcagtaaatttactgatatcttccatggcgcggatggtgatgaccttatagaaggaaatgatgggaatgaccgcttatatggtgataaaggtaatgacacactgagtggtggaaacggagatgaccagctctatggcggtgatggcaacgataagttaattgggggagcaggtaataattacctgaacggcggagatggagatgatgagcttcaggttcagggaaattctcttgcaaaaaatgtattatccggtggaaaaggtaatgacaagctgtacggcagtgagggggcagatctgcttgatggtggagaggggaatgatctcctgaaaggcggatatggtaatgatatttatcgttatctgtcaggatatggtcatcatattattgatgatgatggggggaaagaggataaactcagtttggctgatattgatttccgggatgtggccttcaagcgagaaggtaatgacctcatcatgtataaagctgaaggtaatgttctttccattggtcatgaaaatggtattacattcaggaactggtttgaaaaagagtcaggtgatatctctaatcaccagatagagcagatttttgataaaggtggccggataatcacacctgattcccttaaaaaggcacttgagtatcaacagcgtaataataaggcaagttatgtgtatgggaatgatgcattagcctatggaagtcaggataatcttaatctattaattaatgaaatcagcaaaatcatttcagctgcaggtaacttcgatgttaaagaggaaagaactgcagcttctttattgcagttgtccggtaatgccagtgatttttcatatggacggaactcaataaccctgaccacatcagca

SEQ ID NO: 210 - DNA, 3072 bp, Escherichia coli
atgccaacaataaccactgcacaaattaaaagcacactacagtctgcaaagcaatccgctgcaaataaattgcactcagcaggacaaagcacgaaagatgcattaaaaaaagcagcagagcaaacccgcaatgcgggaaacagactcattttacttatccctaaagattataaaggacagggttcaagccttaatgaccttgtcaggacggcagatgaactgggaattgaagtccagtatgatgaaaagaatggcacggcgattactaaacaggtattcggcacagcagagaaactcattggcctcaccgaacggggagtgactatctttgcaccacaattagacaaattactgcaaaagtatcaaaaagcgggtaataaattaggcggcagtgctgaaaatataggtgataacttaggaaaggcaggcagtgtactgtcaacgtttcaaaattttctgggtactgcactttcctcaatgaaaatagacgaactgataaagaaacaaaaatctggtagcaatgtcagttcttctgaactggcaaaagcgagtattgagctaatcaaccaactcgtggacacagctgccagcattaataataatgttaactcattttctcaacaactcaataagctgggaagtgtattatccaatacaaagcacctgaacggtgttggtaataagttacagaatttacctaaccttgataatatcggtgcagggttagatactgtatcgggtattttatctgcgatttcagcaagcttcattctgagcaatgcagatgcagataccggaactaaagctgcagcaggtgttgaattaacaacgaaagtactgggtaatgttggaaaaggtatttctcaatatattatcgcacagcgcgctgcacaggggttatctacatctgctgctgctgccggtttaattgcttctgtagtgacattagcaattagtcccctctcattcctgtccattgccgataagtttaaacgtgcaaataaaatagaggagtattcacaacgattcaaaaaacttggatacgatggtgacagtttacttgctgctttccacaaagaaacaggagctattgatgcatcattaacaacgataagcactgtactggcttcagtatcttcaggtattagtgctgctgcaacgacatctcttgttggtgcaccggtaagcgcactggtaggtgctgttacggggataatttcaggtatccttgaggcttcaaagcaggcaatgtttgaacatgttgccagtaaaatggctgatgttattgctgaatgggagaaaaaacacggtaaaaattactttgaaaatggatatgatgcccgccatgctgcatttttagaagataactttaaaatattatctcagtataataaagagtattctgttgaaagatcagtcctcattactcaacaacattgggatatgctgataggtgagttagctagtgtcaccagaaatggagacaagacactcagtggtaaaagttatattgactattatgaagagggaaagcggctggaaagaaggccaaaagagttccagcaacaaatctttgatccattaaaaggaaatattgacctttctgacagcaaatcttctacgttattgaaatttgttacgccattgttaactcccggtgaggaaattcgtgaaaggaggcagtccggaaaatatgaatatattaccgagttattagtcaagggtgttgataaatggacggtgaagggggttcaggacaaggggtctgtatatgattactctaacctgattcagcatgcatcagtcggtaataaccagtatcgggaaattcgtattgagtcacacctgggagacggggatgataaggtctttttatctgccggctcagccaatatctacgcaggtaaaggacatgatgttgtttattatgataaaacagacaccggttatctgaccattgatggcacaaaagcaaccgaagcgggtaattacacggtaacacgtgtacttggtggtgatgttaaggttttacaggaagttgtgaaggagcaggaggtttcagtcggaaaaagaactgaaaaaacgcaatatcggagttatgaattcactcatatcaatggtaaaaatttaacagagacagataacttatattccgtggaagaacttattgggaccacgcgtgccgacaagttttttggcagtaaatttactgatatcttccatggcgcggatggtgatgaccatatagaaggaaatgatgggaatgaccgcttatatggtgataaaggtaatgatacgctgaggggcggaaacggggatgaccagctctatggcggtgatggcaatgataagttaattggggggacaggtaataattaccttaacggcggtgacggagatgatgagcttcaggttcaggggaattctcttgctaaaaatgtattatccggtggaaaaggtaatgacaagttgtacggcagtgagggagcagacctgcttgatggcggagaagggaatgatcttctgaaaggtggatatggtaatgatatttatcgttatctttcaggatatggccatcatattattgacgatgaaggggggaaagacgataaactcagtttagctgatatagatttccgggacgttgcctttaagcgagaagggaatgacctcattatgtataaagctgaaggtaatgttctttctattggccacaaaaatggtattacatttaaaaactggtttgaaaaagagtcagatgatctctctaatcatcagatagagcagatttttgataaagacggcagggtaatcacaccagattctcttaaaaaagcatttgaatatcagcagagtaataacaaggtaagttatgtgtatggacatgatgcatcaacttatgggagccaggacaatcttaatccattaattaatgaaatcagcaaaatcatttcagctgcaggtaacttcgatgttaaggaggaaagatctgccgcttctttattgcagttgtccggtaatgccagtgatttttcatatggacggaactcaataactttgacagcatcagca

SEQ ID NO: 211 - protein, 10 aa, Escherichia coli
SLYVIILLFS

SEQ ID NO: 212 - protein, 20 aa, Escherichia coli
  misc_feature 6: 'X' is G/S
SAAITXKESEVVSPLLMDVN

SEQ ID NO: 213 - protein, 20 aa, Escherichia coli
SAAITGKESEVVSPLLMDVN

SEQ ID NO: 214 - protein, 20 aa, Escherichia coli
SAAITSKESEVVSPLLMDVN

SEQ ID NO: 215 - protein, 106 aa, Escherichia coli
SLTMENISELSTSSEPSQQGVFPVICTRLHPGSVMKRQLLTGWGPVFIIGDDPFSLRWMSEHLEILKSLNALGLVVNVESVERMEVLQQRADGLLLLPVICDNFVQ

SEQ ID NO: 216 - protein, 17 aa, Escherichia coli
LQLNAYPVLITEMEISQ

SEQ ID NO: 217 - protein, 8 aa, Escherichia coli
ITGKESEV

SEQ ID NO: 218 - protein, 12 aa, Escherichia coli
ELSTSSEPSQQG

SEQ ID NO: 219 - protein, 12 aa, Escherichia coli
FRYSVLARCVAW

SEQ ID NO: 220 - protein, 20 aa, Escherichia coli
NISVQVLFPLAVTFTPVMAA

SEQ ID NO: 221 - protein, 11 aa, Escherichia coli
AQHAVQPRLSM

SEQ ID NO: 222 - protein, 16 aa, Escherichia coli
  misc_feature 5: 'X' is T/A
  misc_feature 8: 'X' is N/S
NTTVXADXNVEKNVAS

SEQ ID NO: 223 - protein, 16 aa, Escherichia coli
NTTVTADNNVEKNVAS

SEQ ID NO: 224 - protein, 16 aa, Escherichia coli
NTTVTADNNVEKNVAS

SEQ ID NO: 225 - protein, 16 aa, Escherichia coli
NTTVTADNNVEKNVAS

SEQ ID NO: 226 - protein, 47 aa, Escherichia coli
FSLKDSSLEMLYPIYDTPTNMLFTQGAIHRTDDRTQSNIGFGWRHFS

SEQ ID NO: 227 - protein, 47 aa, Escherichia coli
NDWMAGVNTFIDHDLSRSHTRIGVGAEYWRDYLKLSANGYIRASGWK

SEQ ID NO: 228 - protein, 54 aa, Escherichia coli
EDYQERPANGWDIRAEGYLPAWPQLGASLMYEQYYGDEVGLFGKDKRQKDPHAI

SEQ ID NO: 229 - protein, 37 aa, Escherichia coli
YTPVPLLTLSAGHKQGKSGENDTRFGLEVNYRIGEPL

SEQ ID NO: 230 - protein, 12 aa, Escherichia coli
KQLDTDSIRERR

SEQ ID NO: 231 - protein, 30 aa, Escherichia coli
LAGSRYDLVERNNNIVLEYRKSEVIRIALP

SEQ ID NO: 232 - protein, 9 aa, Escherichia coli
  misc_feature 3: 'X' is E/A
RIXGKGGQT

SEQ ID NO: 233 - protein, 9 aa, Escherichia coli
RIEGKGGQT

SEQ ID NO: 234 - protein, 9 aa, Escherichia coli
RIAGKGGQT

SEQ ID NO: 235 - protein, 25 aa, Escherichia coli
SLGLVVSKATHGLKNVQWEAPSLLA

SEQ ID NO: 236 - protein, 16 aa, Escherichia coli
DNKGNASKRVQTEVVI

SEQ ID NO: 237 - protein, 18 aa, Escherichia coli
RTALTLDGQSRIQMLANG

SEQ ID NO: 238 - protein, 25 aa, Escherichia coli
PLVLSLRDAEGQPVTGMKDQIKTEL

SEQ ID NO: 239 - protein, 10 aa, Escherichia coli
FKPAGNIVTR

SEQ ID NO: 240 - protein, 34 aa, Escherichia coli
PTLGEFTETEAGVYQSVFTTGTQSGEATITVSVD

SEQ ID NO: 241 - protein, 14 aa, Escherichia coli
MSKTVTAELRATMM

SEQ ID NO: 242 - protein, 17 aa, Escherichia coli
NSTLSANEPSGDVVADG

SEQ ID NO: 243 - protein, 12 aa, Escherichia coli
GNPVTGEASRLR

SEQ ID NO: 244 - protein, 9 aa, Escherichia coli
VPQDTNGVT

SEQ ID NO: 245 - protein, 12 aa, Escherichia coli
VSSTRAGNVVVR

SEQ ID NO: 246 - protein, 28 aa, Escherichia coli
FSEQYQLGTLQQTLKFVAGPLDAAHSSI

SEQ ID NO: 247 - protein, 17 aa, Escherichia coli
LNPDKPVVGGTVTAIWT

SEQ ID NO: 248 - protein, 10 aa, Escherichia coli
NGDGTWTAQI

SEQ ID NO: 249 - protein, 39 aa, Escherichia coli
AAANAAKVTVVADALSSNQSKVSVAEDHVKAGESTTVTL

SEQ ID NO: 250 - protein, 14 aa, Escherichia coli
  misc_feature 7: 'X' is V/I
  misc_feature 9: 'X' is S/G
ASEGATXSXWTEKG

SEQ ID NO: 251 - protein, 14 aa, Escherichia coli
ASEGATISSWTEKG

SEQ ID NO: 252 - protein, 14 aa, Escherichia coli
ASEGATVSGWTEKG

SEQ ID NO: 253 - protein, 14 aa, Escherichia coli
ASEGATVSSWTEKG

SEQ ID NO: 254 - protein, 15 aa, Escherichia coli
SYVATLTTGGKTGEL

SEQ ID NO: 255 - protein, 33 aa, Escherichia coli
VMPLFNGQPAATEAAQLTVIAGEMSSANSTLVA

SEQ ID NO: 256 - protein, 36 aa, Escherichia coli
TLTLGSAAGQLSVMPRVNGQNAVAQPLVLNVAGDAS

SEQ ID NO: 257 - protein, 10 aa, Escherichia coli
  misc_feature 9: 'X' is T/A
NQLANGQSXN

SEQ ID NO: 258 - protein, 10 aa, Escherichia coli
NQLANGQSTN

SEQ ID NO: 259 - protein, 10 aa, Escherichia coli
NQLANGQSAN

SEQ ID NO: 260 - protein, 15 aa, Escherichia coli
  misc_feature 7: 'X' is S/T
TLTVVDXYGNPLQGQ

SEQ ID NO: 261 - protein, 15 aa, Escherichia coli
TLTVVDSYGNPLQGQ

SEQ ID NO: 262 - protein, 15 aa, Escherichia coli
TLTVVDTYGNPLQGQ

SEQ ID NO: 263 - protein, 12 aa, Escherichia coli
GVTSKTGNTVTT

SEQ ID NO: 264 - protein, 15 aa, Escherichia coli
  misc_feature 11: 'X' is A/V
SVTAGTYEITXSAGN

SEQ ID NO: 265 - protein, 15 aa, Escherichia coli
SVTAGTYEITASAGN

SEQ ID NO: 266 - protein, 15 aa, Escherichia coli
SVTAGTYEITVSAGN

SEQ ID NO: 267 - protein, 15 aa, Escherichia coli
KQTYKVTVTDANNNL

SEQ ID NO: 268 - protein, 13 aa, Escherichia coli
STKTAESKFVADD

SEQ ID NO: 269 - protein, 12 aa, Escherichia coli
  misc_feature 7: 'X' is K/A
  misc_feature 7: 'Xaa' is any amino acid
PEGVTEXDYQFL

SEQ ID NO: 270 - protein, 12 aa, Escherichia coli
PEGVTEKDYQFL

SEQ ID NO: 271 - protein, 12 aa, Escherichia coli
PEGVTEADYQFL

SEQ ID NO: 272 - protein, 11 aa, Escherichia coli
TTVTADNNVEK

SEQ ID NO: 273 - protein, 12 aa, Escherichia coli
FLSSQPDSDATR

SEQ ID NO: 274 - protein, 7 aa, Escherichia coli
TAKANQE

SEQ ID NO: 275 - protein, 11 aa, Escherichia coli
IHRTDDRTQSN

SEQ ID NO: 276 - protein, 23 aa, Escherichia coli
SGWKKSPDVEDYQERPANGWDIR

SEQ ID NO: 277 - protein, 7 aa, Escherichia coli
YLPAWPQ

SEQ ID NO: 278 - protein, 11 aa, Escherichia coli
KDKRQKDPHAI

SEQ ID NO: 279 - protein, 13 aa, Escherichia coli
GHKQGKSGENDTR

SEQ ID NO: 280 - protein, 8 aa, Escherichia coli
KQLDTDSI

SEQ ID NO: 281 - protein, 8 aa, Escherichia coli
IEGKGGQT

SEQ ID NO: 282 - protein, 10 aa, Escherichia coli
DNKGNASKRV

SEQ ID NO: 283 - protein, 13 aa, Escherichia coli
DAEGQPVTGMKDQ

SEQ ID NO: 284 - protein, 13 aa, Escherichia coli
PTLGEFTETEAGV

SEQ ID NO: 285 - protein, 10 aa, Escherichia coli
TTGTQSGEAT

SEQ ID NO: 286 - protein, 15 aa, Escherichia coli
TLSANEPSGDVVADG

SEQ ID NO: 287 - protein, 8 aa, Escherichia coli
GNPVTGEA

SEQ ID NO: 288 - protein, 8 aa, Escherichia coli
PQDTNGVT

SEQ ID NO: 289 - protein, 15 aa, Escherichia coli
IKPGVYSATVSSTRA

SEQ ID NO: 290 - protein, 10 aa, Escherichia coli
LNPDKPVVGG

SEQ ID NO: 291 - protein, 17 aa, Escherichia coli
GSTASGWTNNGDGTWTA

SEQ ID NO: 292 - protein, 6 aa, Escherichia coli
GSTAGE

SEQ ID NO: 293 - protein, 11 aa, Escherichia coli
KLNGQDAAANA

SEQ ID NO: 294 - protein, 10 aa, Escherichia coli
LSSNQSKVSV

SEQ ID NO: 295 - protein, 9 aa, Escherichia coli
DHVKAGEST

SEQ ID NO: 296 - protein, 14 aa, Escherichia coli
ASEGATVSSWTEKG

SEQ ID NO: 297 - protein, 6 aa, Escherichia coli
TGGKTG

SEQ ID NO: 298 - protein, 8 aa, Escherichia coli
GQPAATEA

SEQ ID NO: 299 - protein, 8 aa, Escherichia coli
RVNGQNAV

SEQ ID NO: 300 - protein, 9 aa, Escherichia coli
QLANGQSTN

SEQ ID NO: 301 - protein, 9 aa, Escherichia coli
SYGNPLQGQ

SEQ ID NO: 302 - protein, 12 aa, Escherichia coli
GVTSKTGNTVTT

SEQ ID NO: 303 - protein, 8 aa, Escherichia coli
LMSTVAGE

SEQ ID NO: 304 - protein, 10 aa, Escherichia coli
TYEITASAGN

SEQ ID NO: 305 - protein, 11 aa, Escherichia coli
KQTYKVTVTDA

SEQ ID NO: 306 - protein, 12 aa, Escherichia coli
STKTAESKFVAD

SEQ ID NO: 307 - protein, 6 aa, Escherichia coli
PEGVTE

SEQ ID NO: 308 - protein, 12 aa, Escherichia coli
GGALVTSTAATV

SEQ ID NO: 309 - protein, 12 aa, Escherichia coli
SMLTQAMDYDRI

SEQ ID NO: 310 - protein, 14 aa, Escherichia coli
  misc_feature 6: 'X' is T/S
  misc_feature 9: 'X' is N/S
SRSHQXGVXGENNS

SEQ ID NO: 311 - protein, 14 aa, Escherichia coli
SRSHQTGVNGENNS

SEQ ID NO: 312 - protein, 14 aa, Escherichia coli
SRSHQSGVSGENNS

SEQ ID NO: 313 - protein, 14 aa, Escherichia coli
SRSHQTGVSGENNS

SEQ ID NO: 314 - protein, 11 aa, Escherichia coli
RLSIQGGHLGH

SEQ ID NO: 315 - protein, 13 aa, Escherichia coli
NNGGIARGATPES

SEQ ID NO: 316 - protein, 10 aa, Escherichia coli
AAGHSSVDVK

SEQ ID NO: 317 - protein, 17 aa, Escherichia coli
GWLGSLETGLPFSITDN

SEQ ID NO: 318 - protein, 11 aa, Escherichia coli
YTWQGLSLDDG

SEQ ID NO: 319 - protein, 15 aa, Escherichia coli
ELPVNWWVQPSVIRT

SEQ ID NO: 320 - protein, 10 aa, Escherichia coli
LDLQAGLEAR

SEQ ID NO: 321 - protein, 12 aa, Escherichia coli
RENITLGVQAGY

SEQ ID NO: 322 - protein, 8 aa, Escherichia coli
RARGKRGG

SEQ ID NO: 323 - protein, 11 aa, Escherichia coli
GETVNGGTLAN

SEQ ID NO: 324 - protein, 58 aa, Escherichia coli
GLEYGPDNEANTGGQWVQDGGTANKTTVTSGGLQRVNPGGSVSDTVISAGGGQSLQGR

SEQ ID NO: 325 - protein, 34 aa, Escherichia coli
WQVVKPGTVATDTVVNTGAEGGPDAENGDTGQFV

SEQ ID NO: 326 - protein, 9 aa, Escherichia coli
AVRTTINKN

SEQ ID NO: 327 - protein, 8 aa, Escherichia coli
RAEGTANT

SEQ ID NO: 328 - protein, 10 aa, Escherichia coli
YAGGDQTVHG

SEQ ID NO: 329 - protein, 16 aa, Escherichia coli
QYVHNGGTASDTVVNS

SEQ ID NO: 330 - protein, 29 aa, Escherichia coli
GGVAGNTTVNQKGRLQVDAGGTATNVTLK

SEQ ID NO: 331 - protein, 28 aa, Escherichia coli
HTATNTRVDDGGTLDVRNGGTATTVSMG

SEQ ID NO: 332 - protein, 18 aa, Escherichia coli
GAAVSGTRSDGKAFSIGG

SEQ ID NO: 333 - protein, 13 aa, Escherichia coli
TLNAGDTATDTTV

SEQ ID NO: 334 - protein, 10 aa, Escherichia coli
GTLAGTTTLN

SEQ ID NO: 335 - protein, 17 aa, Escherichia coli
LTGNGSVEKSGSGTLTV

SEQ ID NO: 336 - protein, 9 aa, Escherichia coli
AIDPTNVTL

SEQ ID NO: 337 - protein, 11 aa, Escherichia coli
TWNIPDNATVQ

SEQ ID NO: 338 - protein, 6 aa, Escherichia coli
SHAGQI

SEQ ID NO: 339 - protein, 7 aa, Escherichia coli
NLNGQNG

SEQ ID NO: 340 - protein, 6 aa, Escherichia coli
DMAQNN

SEQ ID NO: 341 - protein, 14 aa, Escherichia coli
AGNSASGLATSGKG

SEQ ID NO: 342 - protein, 11 aa, Escherichia coli
NGATTEEGAFV

SEQ ID NO: 343 - protein, 9 aa, Escherichia coli
NRDSDESWY

SEQ ID NO: 344 - protein, 22 aa, Escherichia coli
HLGHDNNGGIARGATPESSGSY

SEQ ID NO: 345 - protein, 24 aa, Escherichia coli
YGAAGHSSVDVKDDDGSRAGTVRD

SEQ ID NO: 346 - protein, 16 aa, Escherichia coli
TRHSMKASSDNNDFRA

SEQ ID NO: 347 - protein, 11 aa, Escherichia coli
SLDDGKDNAGY

SEQ ID NO: 348 - protein, 21 aa, Escherichia coli
DMTFGEGTSSRAPLRDSAKHS

SEQ ID NO: 349 - protein, 24 aa, Escherichia coli
DMRVGTSTAGSGMTFSPSQNGTSL

SEQ ID NO: 350 - protein, 18 aa, Escherichia coli
YAHSVSGSSAEGYNGQAT

SEQ ID NO: 351 - protein, 66 aa, Escherichia coli
MLRRSLIFLVLLSAGCVSLDPHYSTPESPIPATLPGAQGQGKAISHDWQQVIHDPRLQQVVTIALN

SEQ ID NO: 352 - protein, 45 aa, Escherichia coli
NRDVQKAIADIDSARALYGQTNASLFPTVNAALSSTRSRSLANGT

SEQ ID NO: 353 - protein, 11 aa, Escherichia coli
TTAEADGTVSS

SEQ ID NO: 354 - protein, 27 aa, Escherichia coli
TLDLFGRNQSLSRAARETWLASEFTAQ

SEQ ID NO: 355 - protein, 30 aa, Escherichia coli
TRLTLIAEISTAWLTLAADNSNLALAKETM

SEQ ID NO: 356 - protein, 59 aa, Escherichia coli
SAENSLKIIQRQQQVGTAAATDVSEAMSVYQQARASVASYQTQVMQDKNALNLLAGTTL

SEQ ID NO: 357 - protein, 85 aa, Escherichia coli
ENLLPGTLESLPEQMISLVPAGVSSDVLLRRPDIQEAEHNLKSANADIGAARANFFPTISLTASAGVGSDALSSLFSHGMQIWSF

SEQ ID NO: 358 - protein, 33 aa, Escherichia coli
PSVTLPLFTGGSNLAQLRYAEAQKRGLIATYEK

SEQ ID NO: 359 - protein, 18 aa, Escherichia coli
VANALARRTTLEEQLDAQ

SEQ ID NO: 360 - protein, 18 aa, Escherichia coli
QYVKAEQQTVDVGLRRYQ

SEQ ID NO: 361 - protein, 48 aa, Escherichia coli
GVGDYLTVLTAQRSLWSAQQELLALQLTDFTNRITLWQSLGGGMSSLK

SEQ ID NO: 362 - protein, 26 aa, Escherichia coli
DPHYSTPESPIPATLPGAQGQGKAIS

SEQ ID NO: 363 - protein, 19 aa, Escherichia coli
SRSLANGTGTTAEADGTVS

SEQ ID NO: 364 - protein, 13 aa, Escherichia coli
QQVGTAAATDVSE

SEQ ID NO: 365 - protein, 6 aa, Escherichia coli
RASVAS

SEQ ID NO: 366 - protein, 18 aa, Escherichia coli
DIQEAEHNLKSANADIGA

SEQ ID NO: 367 - protein, 7 aa, Escherichia coli
SAGVGSD

SEQ ID NO: 368 - protein, 10 aa, Escherichia coli
QYVKAEQQTV

SEQ ID NO: 369 - protein, 16 aa, Escherichia coli
RMQQQLGRTRSQQEYQ

SEQ ID NO: 370 - protein, 28 aa, Escherichia coli
ALWYSASAESLALSALSLSLKNEKRVHL

SEQ ID NO: 371 - protein, 34 aa, Escherichia coli
SGPRFFPLPQGQIAVTLRDAQACFNLNALAQPTT

SEQ ID NO: 372 - protein, 22 aa, Escherichia coli
VPAYRAELIAESLWEFIDEDRS

SEQ ID NO: 373 - protein, 38 aa, Escherichia coli
QTRLGREDSEYLARSVPFYAANQPLADISEMRVVQGMD

SEQ ID NO: 374 - protein, 15 aa, Escherichia coli
GLYQKLKPLVCALPM

SEQ ID NO: 375 - protein, 15 aa, Escherichia coli
RQQININTLDVTQSV

SEQ ID NO: 376 - protein, 42 aa, Escherichia coli
LEALFDPWLSPVQARALLQQRPAKGWEDVDQFLAQPLLADVD

SEQ ID NO: 377 - protein, 27 aa, Escherichia coli
LSVDSNYFWLRSDITVNEIELTMNSLI

SEQ ID NO: 378 - protein, 11 aa, Escherichia coli
QLGRTRSQQEY

SEQ ID NO: 379 - protein, 11 aa, Escherichia coli
PWASGPRFFPL

SEQ ID NO: 380 - protein, 9 aa, Escherichia coli
AQPTTASRP

SEQ ID NO: 381 - protein, 9 aa, Escherichia coli
RLGREDSEY

SEQ ID NO: 382 - protein, 8 aa, Escherichia coli
YAANQPLA

SEQ ID NO: 383 - protein, 8 aa, Escherichia coli
RPAKGWED

SEQ ID NO: 384 - protein, 6 aa, Escherichia coli
DERTKK

SEQ ID NO: 385 - protein, 16 aa, Escherichia coli
LALMAQQVTNGVTRVN

SEQ ID NO: 386 - protein, 15 aa, Escherichia coli
HDQKLNLMQQTMSFL

SEQ ID NO: 387 - protein, 13 aa, Escherichia coli
HDLTQMMPRPVRG

SEQ ID NO: 388 - protein, 11 aa, Escherichia coli
QGQREPALLAG

SEQ ID NO: 389 - protein, 13 aa, Escherichia coli
PRSNLLTVGYRIH

SEQ ID NO: 390 - protein, 13 aa, Escherichia coli
  misc_feature 8: 'X' is G/D
WPLTDAAXSVKPT

SEQ ID NO: 391 - protein, 13 aa, Escherichia coli
WPLTDAAGSVKPT

SEQ ID NO: 392 - protein, 13 aa, Escherichia coli
WPLTDAADSVKPT

SEQ ID NO: 393 - protein, 10 aa, Escherichia coli
WQESWSSVQA

SEQ ID NO: 394 - protein, 20 aa, Escherichia coli
TLHSPQWGEIERIWLLRGPQ

SEQ ID NO: 395 - protein, 6 aa, Escherichia coli
TNGVTR

SEQ ID NO: 396 - protein, 6 aa, Escherichia coli
AVAGHD

SEQ ID NO: 397 - protein, 14 aa, Escherichia coli
PRPVRGDQGQREPA

SEQ ID NO: 398 - protein, 9 aa, Escherichia coli
TRWQESWSS

SEQ ID NO: 399 - protein, 19 aa, Escherichia coli
KGRALFSLLFAAPMIHATD

SEQ ID NO: 400 - protein, 260 aa, Escherichia coli
TTKDGETITVTADANTATEATDGYQPLSTSTATLTDMPMLDIPQVVNTVSDQVLENQNATTLDEALYNVSNVVQTNTLGGTQDAFVRRGFGANRDGSIMTNGLRTVLPRSFNAATERVEVLKGPASTLYGILDPGGLINVVTKRPEKTFHGSVSATSSSFGGGTGQLDITGPIEGTQLAYRLTGEVQDEDYWRNFGKERSTFIAPSLTWFGDNATVTMLYSHRDYKTPFDRGTIFDLTTKQPVNVDRKIRFDEPFNITDG

SEQ ID NO: 401 - protein, 61 aa, Escherichia coli
SDLAQLNAEYHLNSQWTARFDYSYSQDKYSDNQARVTAYDATTGTLTRRVDATQGSTQRMH

SEQ ID NO: 402 - protein, 38 aa, Escherichia coli
TRADLQGNVDIAGFYNEILGGVSYEYYDLLRTDMIRCK

SEQ ID NO: 403 - protein, 32 aa, Escherichia coli
AKDFNIYNPVYGNTSKCTTVSASDSDQTIKQE

SEQ ID NO: 404 - protein, 123 aa, Escherichia coli
YSAYAQDALYLTDNWIAVAGIRYQYYTQYAGKGRPFNVNTDSRDEQWTPKLGLVYKLTPSVSLFANYSQTFMPQSSIASYIGDLPPESSNAYEVGAKFELFDGITADIALFDIHKRNVLYTES

SEQ ID NO: 405 - protein, 55 aa, Escherichia coli
GDETIAKTAGRVRSRGVEVDLAGALTENINIIASYGYTDAKVLEDPDYAGKPLPN

SEQ ID NO: 406 - protein, 29 aa, Escherichia coli
PRHTGSLFLTYDIHNMPGNNTLTFGGGGH

SEQ ID NO: 407 - protein, 76 aa, Escherichia coli
VSRRSATNGADYYLPGYFVADAFAAYKMKLQYPVTLQLNVKNLFDKTYYTSSIATNNLGNQIGDPREVQFTVKMEF

SEQ ID NO: 408 - protein, 36 aa, Escherichia coli
SVTTKDGETITVTADANTATEATDGYQPLSTSTATL

SEQ ID NO: 409 - protein, 10 aa, Escherichia coli
VLENQNATTL

SEQ ID NO: 410 - protein, 9 aa, Escherichia coli
NTLGGTQDA

SEQ ID NO: 411 - protein, 8 aa, Escherichia coli
GANRDGSI

SEQ ID NO: 412 - protein, 33 aa, Escherichia coli
KRPEKTFHGSVSATSSSFGGGTGQLDITGPIEG

SEQ ID NO: 413 - protein, 11 aa, Escherichia coli
GEVQDEDYWRN

SEQ ID NO: 414 - protein, 7 aa, Escherichia coli
DYKTPFD

SEQ ID NO: 415 - protein, 6 aa, Escherichia coli
KQPVNV

SEQ ID NO: 416 - protein, 10 aa, Escherichia coli
FNITDGQSDL

SEQ ID NO: 417 - protein, 25 aa, Escherichia coli
SYSQDKYSDNQARVTAYDATTGTLT

SEQ ID NO: 418 - protein, 11 aa, Escherichia coli
VDATQGSTQRM

SEQ ID NO: 419 - protein, 29 aa, Escherichia coli
PVYGNTSKCTTVSASDSDQTIKQESYSAY

SEQ ID NO: 420 - protein, 21 aa, Escherichia coli
QYAGKGRPFNVNTDSRDEQWT

SEQ ID NO: 421 - protein, 12 aa, Escherichia coli
GDLPPESSNAYE

SEQ ID NO: 422 - protein, 10 aa, Escherichia coli
SVGDETIAKT

SEQ ID NO: 423 - protein, 20 aa, Escherichia coli
AKVLEDPDYAGKPLPNVPRH

SEQ ID NO: 424 - protein, 29 aa, Escherichia coli
NMPGNNTLTFGGGGHGVSRRSATNGADYY

SEQ ID NO: 425 - protein, 16 aa, Escherichia coli
IATNNLGNQIGDPREV

SEQ ID NO: 426 - protein, 185 aa, Escherichia coli
KKTLLSMFATALLSGVAFNALADDANQGSGKITFKGEVIDAPCSIAPGDEDQTINLGEVADTVLKSGQKSLPVDVTIHLQDCILSDGTNTVDKVKITFSSASVDATDSNLLKNTLEGNIGGATDVGVRLVKSDNTNVTLGTPITINFPTTNSYQELNFKARMESLGRTATPGNVQAQANYVLDYK

SEQ ID NO: 427 - protein, 12 aa, Escherichia coli
ADDANQGSGKIT

SEQ ID NO: 428 - protein, 13 aa, Escherichia coli
CSIAPGDEDQTIN

SEQ ID NO: 429 - protein, 8 aa, Escherichia coli
ASVDATDS

SEQ ID NO: 430 - protein, 9 aa, Escherichia coli
EGNIGGATD

SEQ ID NO: 431 - protein, 8 aa, Escherichia coli
NFPTTNSY

SEQ ID NO: 432 - protein, 13 aa, Escherichia coli
LGRTATPGNVQAQ

SEQ ID NO: 433 - protein, 19 aa, Escherichia coli
MPTITTAQIKSTLQSAKQS

SEQ ID NO: 434 - protein, 19 aa, Escherichia coli
NKLHSAGQSTKDALKKAAE

SEQ ID NO: 435 - protein, 71 aa, Escherichia coli
TRNAGNRLILLIPKDYKGQGSSLNDLVRTADELGIEVQYDEKNGTAITKQVFGTAEKLIGLTERGVTIFAP

SEQ ID NO: 436 - protein, 30 aa, Escherichia coli
LDKLLQKYQKAGNKLGGSAENIGDNLGKAG

SEQ ID NO: 437 - protein, 22 aa, Escherichia coli
LSTFQNFLGTALSSMKIDELIK

SEQ ID NO: 438 - protein, 15 aa, Escherichia coli
ASIELINQLVDTAAS

SEQ ID NO: 439 - protein, 12 aa, Escherichia coli
NNNVNSFSQQLN

SEQ ID NO: 440 - protein, 11 aa, Escherichia coli
LGSVLSNTKHL

SEQ ID NO: 441 - protein, 27 aa, Escherichia coli
GVGNKLQNLPNLDNIGAGLDTVSGILS

SEQ ID NO: 442 - protein, 14 aa, Escherichia coli
ISASFILSNADADT

SEQ ID NO: 443 - protein, 46 aa, Escherichia coli
TKAAAGVELTTKVLGNVGKGISQYIIAQRAAQGLSTSAAAAGLIAS

SEQ ID NO: 444 - protein, 44 aa, Escherichia coli
LAISPLSFLSIADKFKRANKIEEYSQRFKKLGYDGDSLLAAFHK

SEQ ID NO: 445 - protein, 97 aa, Escherichia coli
TGAIDASLTTISTVLASVSSGISAAATTSLVGAPVSALVGAVTGIISGILEASKQAMFEHVASKMADVIAEWEKKHGKNYFENGYDARHAAFLEDNF

SEQ ID NO: 446 - protein, 15 aa, Escherichia coli
YSVERSVLITQQHWD

SEQ ID NO: 447 - protein, 25 aa, Escherichia coli
VTRNGDKTLSGKSYIDYYEEGKRLE

SEQ ID NO: 448 - protein, 11 aa, Escherichia coli
FDPLKGNIDLS

SEQ ID NO: 449 - protein, 34 aa, Escherichia coli
EIRERRQSGKYEYITELLVKGVDKWTVKGVQDKG

SEQ ID NO: 450 - protein, 19 aa, Escherichia coli
VYDYSNLIQHASVGNNQYR

SEQ ID NO: 451 - protein, 16 aa, Escherichia coli
IRIESHLGDGDDKVFL

SEQ ID NO: 452 - protein, 49 aa, Escherichia coli
AGSANIYAGKGHDVVYYDKTDTGYLTIDGTKATEAGNYTVTRVLGGDVK

SEQ ID NO: 453 - protein, 26 aa, Escherichia coli
KEQEVSVGKRTEKTQYRSYEFTHING

SEQ ID NO: 454 - protein, 16 aa, Escherichia coli
LTETDNLYSVEELIGT

SEQ ID NO: 455 - protein, 21 aa, Escherichia coli
RADKFFGSKFTDIFHGADGDD

SEQ ID NO: 456 - protein, 19 aa, Escherichia coli
IEGNDGNDRLYGDKGNDTL

SEQ ID NO: 457 - protein, 17 aa, Escherichia coli
GGNGDDQLYGGDGNDKL

SEQ ID NO: 458 - protein, 75 aa, Escherichia coli
GNNYLNGGDGDDELQVQGNSLAKNVLSGGKGNDKLYGSEGADLLDGGEGNDLLKGGYGNDIYRYLSGYGHHIIDD

SEQ ID NO: 459 - protein, 15 aa, Escherichia coli
DKLSLADIDFRDVAF

SEQ ID NO: 460 - protein, 20 aa, Escherichia coli
REGNDLIMYKAEGNVLSIGH

SEQ ID NO: 461 - protein, 11 aa, Escherichia coli
SNHQIEQIFDK

SEQ ID NO: 462 - protein, 21 aa, Escherichia coli
LINEISKIISAAGNFDVKEER

SEQ ID NO: 463 - protein, 24 aa, Escherichia coli
AASLLQLSGNASDFSYGRNSITLT

SEQ ID NO: 464 - protein, 32 aa, Escherichia coli
QSAKQSAANKLHSAGQSTKDALKKAAEQTRNA

SEQ ID NO: 465 - protein, 8 aa, Escherichia coli
DYKGQGSS

SEQ ID NO: 466 - protein, 10 aa, Escherichia coli
QYDEKNGTAI

SEQ ID NO: 467 - protein, 20 aa, Escherichia coli
QKAGNKLGGSAENIGDNLGK

SEQ ID NO: 468 - protein, 15 aa, Escherichia coli
IKKQKSGSNVSSSEL

SEQ ID NO: 469 - protein, 12 aa, Escherichia coli
ADADTGTKAAAG

SEQ ID NO: 470 - protein, 9 aa, Escherichia coli
AQGLSTSAA

SEQ ID NO: 471 - protein, 6 aa, Escherichia coli
SGISAA

SEQ ID NO: 472 - protein, 15 aa, Escherichia coli
EKKHGKNYFENGYDA

SEQ ID NO: 473 - protein, 11 aa, Escherichia coli
GVTRNGDKTLS

SEQ ID NO: 474 - protein, 18 aa, Escherichia coli
DYYEEGKRLEKKPDEFQK

SEQ ID NO: 475 - protein, 8 aa, Escherichia coli
IDLSDSKS

SEQ ID NO: 476 - protein, 16 aa, Escherichia coli
LTPGEEIRERRQSGKY

SEQ ID NO: 477 - protein, 11 aa, Escherichia coli
VKGVQDKGSVY

SEQ ID NO: 478 - protein, 7 aa, Escherichia coli
SVGNNQY

SEQ ID NO: 479 - protein, 7 aa, Escherichia coli
HLGDGDD

SEQ ID NO: 480 - protein, 9 aa, Escherichia coli
YDKTDTGYL

SEQ ID NO: 481 - protein, 10 aa, Escherichia coli
GTKATEAGNY

SEQ ID NO: 482 - protein, 13 aa, Escherichia coli
EVSVGKRTEKTQY

SEQ ID NO: 483 - protein, 7 aa, Escherichia coli
GTDLTET

SEQ ID NO: 484 - protein, 65 aa, Escherichia coli
HGADGDDHIEGNDGNDRLYGDKGNDTLRGGNGDDQLYGGDGNDKLTGGVGNNYLNGGDGDDELQV

SEQ ID NO: 485 - protein, 34 aa, Escherichia coli
LSGGKGNDKLYGSEGADLLDGGEGNDLLKGGYGN

SEQ ID NO: 486 - protein, 11 aa, Escherichia coli
IDDDGGKDDKL

SEQ ID NO: 487 - protein, 10 aa, Escherichia coli
EKESGDISNH

SEQ ID NO: 488 - protein, 10 aa, Escherichia coli
GRVITPDSLK

SEQ ID NO: 489 - protein, 12 aa, Escherichia coli
EYQQSNNQANYV

SEQ ID NO: 490 - protein, 8 aa, Escherichia coli
YASTYADL

SEQ ID NO: 491 - protein, 9 aa, Escherichia coli
NFDVKEERS

SEQ ID NO: 492 - protein, 8 aa, Escherichia coli
GNASDFSY

SEQ ID NO: 493 - protein, 31 aa, Escherichia coli
VSLSTALRMTCRRRLLSLIVGPASLNRFIPP

SEQ ID NO: 494 - protein, 17 aa, Escherichia coli
QHFGQRHNVSNGWRPVK

SEQ ID NO: 495 - protein, 95 aa, Escherichia coli
GGDICHQIVNRQAVGKPASTDFFNKKVTTSTDMAVRSAGSISAISCAVSAGLEMRGITVIIAFTSISIMACRRVPRSAPDCGLRSTISVISVLPR

SEQ ID NO: 496 - protein, 15 aa, Escherichia coli
HNVSNGWRPVKNGGD

SEQ ID NO: 497 - protein, 10 aa, Escherichia coli
AVGKPASTDF

SEQ ID NO: 498 - protein, 10 aa, Escherichia coli
VTTSTDMAVR

SEQ ID NO: 499 - protein, 9 aa, Escherichia coli
VPRSAPDCG

SEQ ID NO: 500 - protein, 11 aa, Escherichia coli
MIHLFKTCMIT

SEQ ID NO: 501 - protein, 115 aa, Escherichia coli
WSAPLRAQDQRYISIRNTDTIWLPGNICAYQFRLDNGGNDEGFGPLTITLQLKDKYGQTLVTRKMETEAFGDSNATRTTDAFLETECVENVATTEIIKATEESNGHRVSLPLSVF

SEQ ID NO: 502 - protein, 17 aa, Escherichia coli
PQDYHPLLITVSGKNVN

SEQ ID NO: 503 - protein, 10 aa, Escherichia coli
DNGGNDEGFG

SEQ ID NO: 504 - protein, 12 aa, Escherichia coli
TEAFGDSNATRT

SEQ ID NO: 505 - protein, 10 aa, Escherichia coli
KATEESNGHR

SEQ ID NO: 506 - protein, 6 aa, Escherichia coli
FDPQDY

SEQ ID NO: 507 - protein, 22 aa, Escherichia coli
IVVSVLAMSSAAVSAAEGDESV

SEQ ID NO: 508 - protein, 102 aa, Escherichia coli
TTVNGGVIHFKGEVVNAACAIDSESMNQTVELGQVRSSRLAKAGDLSSAVGFNIKLNDCDTNVSSNAAVAFLGTTVTSNDDTLALQSSAAGSAQNVGIQILD

SEQ ID NO: 509 - protein, 15 aa, Escherichia coli
TFSAKTDLIDGTNIL

SEQ ID NO: 510 - protein, 27 aa, Escherichia coli
FQARYIALGQSVAGTANADATFKVQYL

SEQ ID NO: 511 - protein, 14 aa, Escherichia coli
VSAAEGDESVTTTV

SEQ ID NO: 512 - protein, 7 aa, Escherichia coli
DTNVSSN

SEQ ID NO: 513 - protein, 10 aa, Escherichia coli
TVTSNDDTLA

SEQ ID NO: 514 - protein, 8 aa, Escherichia coli
SAAGSAQN

SEQ ID NO: 515 - protein, 10 aa, Escherichia coli
SVAGTANADA

SEQ ID NO: 516 - protein, 137 aa, Escherichia coli
YKVIWNHTTQKWDVVSELTSCRKKCKSTRLGIALSAMVLGGAIAINCNNAMADVILSPDWRPGTNNSGVGAATVSGKTEYITGPNVVQSGGSGLIWMTVEQAILNGYTTGDNLSGLIYVNTGEKTKTITVKDEVTGA

SEQ ID NO: 517 - protein, 402 aa, Escherichia coli
QTLQVFDTDSFSQRDAGTGGNETIPGFSGTADFFNATRFVTANNGGTAILDVGSPAIGNFFKNTQLAVADGEGSSVVWNSVNDFYFQPGATMQGGGVTQKIIDSMKYAGTITDWAGKVHHINSLDDLKQYNQYLIKSLEDKTLSYKQYDAEFNKALIVTKHNYNVDMTAGGRIDSTPYKENVGLLAVLHATNNARAILGKTGKLTGVLPAYGNGGGIVATNGGTGVNEGVIDAIGTEMIAYQDSTIVNDGTLFVWDNNDKYALQAEGMVAGSNGSSAINNGVINIRPFKNAFAPEGINTAIVVSNGGMATNKGTINITADASTNDNNGKTRGVNVGAGGSFINSAFGSINVGIAEDKTATHSAVGSVAIEVQNGANKVVNEGTIFLGRGAQGNYGILAKDAG

SEQ ID NO: 518 - protein, 13 aa, Escherichia coli
VDVVNKGTITIDG

SEQ ID NO: 519 - protein, 53 aa, Escherichia coli
DSDAPALNVGMLANNSSGMKNSGIINVNGLNSTGLQVINAGQLNSDGTINVGG

SEQ ID NO: 520 - protein, 16 aa, Escherichia coli
GISSGFRNYGAWVEGA

SEQ ID NO: 521 - protein, 307 aa, Escherichia coli
GTGAVGVFAKDGGSLTLSGNGAVLFGSSDQIGFYVYGKDSAIHNTGSGVMDVSTENSTLFRIASGATFQGTADASSALTASGKNSYALIATGKSDGGVASTVTSGGMTINLTGEGATATLIEGGAQGTIESNAIINMDNASAIAGIADGNGYDISGKLINPKDKTTLLTAGAQLSSTQDKVTGYIARNGATLNNTGNIIFTGKNTVGVRVEEGAVGTNSGNITVQDGGVGLIANATQDVTTINNSGNLVLKGGDNANRTTGIKASGTTTTVNMTAGTISLQGQGAIGVEASNKGTVNLDGSAVPNFA

SEQ ID NO: 522 - protein, 165 aa, Escherichia coli
DGSGITDQIAFRIIGDGATIKTNIAPGTLLDASGERSVLFRIEDGAKQAGSLLMKTSGTGSRGIWATGKGSNVLADAGSDFQILGAQAQGLYVTGGATATLKQGASVNLVGDGAVVAEVDGNEYALDGSITQTNTGSVITNEADISSPLNNAKGFITRNQGLLIN

SEQ ID NO: 523 - protein, 39 aa, Escherichia coli
GNIDFTTGTDNIGVWVDNGRFENTGSRIAVNGVALFVEG

SEQ ID NO: 524 - protein, 140 aa, Escherichia coli
QITSTGGDIVAVDGEAAIKLGAGASLNLAGSGLGTIEGQKNAHGILLDTGAVGLVIDGAKINVNAAGAVGHGIENRAEIEGIQLTNTTEINVADGIGVRTSASLAKTNSGTINVDGSGIALAFQKADGSETDNNLDMSDS

SEQ ID NO: 525 - protein, 22 aa, Escherichia coli
GTGIFANTKDGAVVKSGASVNV

SEQ ID NO: 526 - protein, 51 aa, Escherichia coli
QADGGSALVVNNAASEVVQSGNLISASLSHAVVDASKAQSFTNKGQIKAAS

SEQ ID NO: 527 - protein, 61 aa, Escherichia coli
TGTAMAFDDAVNTTVLNDSGAEIQGVVALNGGDNTFTNKGSITGTVSAKEGNNTFLFDDGS

SEQ ID NO: 528 - protein, 13 aa, Escherichia coli
AGNGNNNVTLNGK

SEQ ID NO: 529 - protein, 43 aa, Escherichia coli
VTAGTGKNTFTIKGEGATWNLLDGGQGDSDSLIFDNAIHTLDS

SEQ ID NO: 530 - protein, 25 aa, Escherichia coli
NFEHVGLKNSSLVTLKEALVLTDGG

SEQ ID NO: 531 - protein, 228 aa, Escherichia coli
GPGSVDIESGSELAIIPAVAGNFTFDPLLTGKGTLSARLDADTSAFEFSHNVGDQFAGTLKLGTSSFALEGLNTSGLTHAMLMSETGNITTVGSGVQQIGGLGFNGGTLIFGSVMPGDTIASNSIETSAAGTLDIRGKGTIQVTMPDEVINDIPAVDTRKNLLEQDDAQTLVTLVNAAGTVTGTGGQLQLVDENGQAISHSQTFDVTQGGEVVAQGNYDYKLLGSSDG

SEQ ID NO: 532 - protein, 90 aa, Escherichia coli
KGDGLYIGYGLKSLDLQGTGDKALVLTPRANAQGLQTDLGAQLTGAGDLAIEAAGQVVTLSNGGNNYTGDTLVRSGTLQMANDNVLGATG

SEQ ID NO: 533 - protein, 11 aa, Escherichia coli
LNVASNAVFRT

SEQ ID NO: 534 - protein, 47 aa, Escherichia coli
GYSQTVGALQTETGAHIQLDSGSVLTVSGTQRQPGDDNGGIIENNVL

SEQ ID NO: 535 - protein, 22 aa, Escherichia coli
GTLAVTGSNLTVHGTNIGFTGN

SEQ ID NO: 536 - protein, 45 aa, Escherichia coli
LVEMNGAQGLGSQGSISFESLNDRLAIDIADGSGVSSNLSKSLSG

SEQ ID NO: 537 - protein, 17 aa, Escherichia coli
GSVGILNTTDLTLSGDN

SEQ ID NO: 538 - protein, 76 aa, Escherichia coli
NFSGEFRVQKDAALRASDEKHLGTGLIDSDGVTWLTASGNWLLKNDITGSGALVKQGAGNLIINHELTYTGDTTVE

SEQ ID NO: 539 - protein, 61 aa, Escherichia coli
GVLIVGDDSVTRAAGATLSGSKNIHVLNGGTLSGLGTVSGQVNNQGTLASLNALSGYETAE

SEQ ID NO: 540 - protein, 48 aa, Escherichia coli
GNFTVGSLTNTGVIRLAGGKTGNTLTVNGDYTGGGTLIINTVLGDDTS

SEQ ID NO: 541 - protein, 81 aa, Escherichia coli
TDKLIVTGNTSGDTGVVVNNVRGQGAQTADGIEIVHVGGQSDGNFRLQNRAVAGAWEYFLHKGNAGGTDGNWYLRSELPPE

SEQ ID NO: 542 - protein, 113 aa, Escherichia coli
PQPQPQPQPQPQPHPTPDKPVQKVYRPEAGSYIANIAAANTLFNIRMHDREGETYYTDVFTGEKKATSMWMRHIGGHNRWKDSSSQLNTQSNRYVVQLGGSIAQWTDGQDRLQ

SEQ ID NO: 543 - protein, 235 aa, Escherichia coli
GIMAGYGNEKSSTTSSLSGYKSKGAINGYSTGLYGTWQQNDGNDNGAYVDTWIQYGWFNNTVNGEKLAAESWKSRGFTGSVEAGYTFKAGEFTGSQGSHYDWYIQPQSQITWMNVRASEHTEKNGTKVQLSGDGNIQSRLGVRTYLKGKSASDDNKAHQFEPFVEVNWIHNTRSWGVKMDNTALSQDGATNIAEVKTGVQGKLSDNLNVWGNVGVQAGDKGYSDAQAMLGIKYIF

SEQ ID NO: 544 - protein, 33 aa, Escherichia coli
DWRPGTNNSGVGAATVSGKTEYITGPNVVQSGG

SEQ ID NO: 545 - protein, 6 aa, Escherichia coli
YTTGDN

SEQ ID NO: 546 - protein, 19 aa, Escherichia coli
TGEKTKTITVKDEVTGASQ

SEQ ID NO: 547 - protein, 22 aa, Escherichia coli
DSFSQRDAGTGGNETIPGFSGT

SEQ ID NO: 548 - protein, 7 aa, Escherichia coli
TANNGGT

SEQ ID NO: 549 - protein, 10 aa, Escherichia coli
AVADGEGSSV

SEQ ID NO: 550 - protein, 10 aa, Escherichia coli
GATMQGGGVT

SEQ ID NO: 551 - protein, 15 aa, Escherichia coli
DMTAGGRIDSTPYKE

SEQ ID NO: 552 - protein, 21 aa, Escherichia coli
PAYGNGGGIVATNGGTGVNEG

SEQ ID NO: 553 - protein, 6 aa, Escherichia coli
NDKYAL

SEQ ID NO: 554 - protein, 11 aa, Escherichia coli
MVAGSNGSSAI

SEQ ID NO: 555 - protein, 7 aa, Escherichia coli
AFAPEGI

SEQ ID NO: 556 - protein, 33 aa, Escherichia coli
GGMATNKGTINITADASTNDNNGKTRGVNVGAG

SEQ ID NO: 557 - protein, 11 aa, Escherichia coli
AEDKTATHSAV

SEQ ID NO: 558 - protein, 8 aa, Escherichia coli
QNGANKVV

SEQ ID NO: 559 - protein, 7 aa, Escherichia coli
AGTVDVV

SEQ ID NO: 560 - protein, 13 aa, Escherichia coli
TITIDGHDSDAPA

SEQ ID NO: 561 - protein, 18 aa, Escherichia coli
QLNSDGTINVGGKGISSG

SEQ ID NO: 562 - protein, 12 aa, Escherichia coli
AWVEGAGSNVNV

SEQ ID NO: 563 - protein, 10 aa, Escherichia coli
AKDGGSLTLS

SEQ ID NO: 564 - protein, 16 aa, Escherichia coli
SAIHNTGSGVMDVSTE

SEQ ID NO: 565 - protein, 19 aa, Escherichia coli
ATFQGTADASSALTASGKN

SEQ ID NO: 566 - protein, 15 aa, Escherichia coli
TGKSDGGVASTVTSG

SEQ ID NO: 567 - protein, 19 aa, Escherichia coli
TGEGATATLIEGGAQGTIE

SEQ ID NO: 568 - protein, 10 aa, Escherichia coli
GIADGNGYDI

SEQ ID NO: 569 - protein, 8 aa, Escherichia coli
INPKDKTT

SEQ ID NO: 570 - protein, 10 aa, Escherichia coli
QLSSTQDKVT

SEQ ID NO: 571 - protein, 23 aa, Escherichia coli
TVGVRVEEGAVGTNSGNITVQDG

SEQ ID NO: 572 - protein, 9 aa, Escherichia coli
TQDVTTINN

SEQ ID NO: 573 - protein, 21 aa, Escherichia coli
GDNANRTTGIKASGTTTTVNM

SEQ ID NO: 574 - protein, 30 aa, Escherichia coli
AIGVEASNKGTVNLDGSAVPNFAADGSGIT

SEQ ID NO: 575 - protein, 8 aa, Escherichia coli
ATIKTNIA

SEQ ID NO: 576 - protein, 7 aa, Escherichia coli
LLDASGE

SEQ ID NO: 577 - protein, 20 aa, Escherichia coli
SGTGSRGIWATGKGSNVLAD

SEQ ID NO: 578 - protein, 9 aa, Escherichia coli
GATATLKQG

SEQ ID NO: 579 - protein, 14 aa, Escherichia coli
AVVAEVDGNEYALD

SEQ ID NO: 580 - protein, 23 aa, Escherichia coli
SITQTNTGSVITNEADISSPLNN

SEQ ID NO: 581 - protein, 9 aa, Escherichia coli
IDFTTGTDN

SEQ ID NO: 582 - protein, 10 aa, Escherichia coli
GRFENTGSRI

SEQ ID NO: 583 - protein, 14 aa, Escherichia coli
QSQITSTGGDIVAV

SEQ ID NO: 584 - protein, 9 aa, Escherichia coli
LGTIEGQKN

SEQ ID NO: 585 - protein, 13 aa, Escherichia coli
AGAVGHGIENRAE

SEQ ID NO: 586 - protein, 14 aa, Escherichia coli
SLAKTNSGTINVDG

SEQ ID NO: 587 - protein, 14 aa, Escherichia coli
KADGSETDNNLDMS

SEQ ID NO: 588 - protein, 18 aa, Escherichia coli
GTDGTGIFANTKDGAVVK

SEQ ID NO: 589 - protein, 6 aa, Escherichia coli
IQADGG

SEQ ID NO: 590 - protein, 24 aa, Escherichia coli
ASKAQSFTNKGQIKAASTTGTAMA

SEQ ID NO: 591 - protein, 9 aa, Escherichia coli
VLNDSGAEI

SEQ ID NO: 592 - protein, 24 aa, Escherichia coli
LNGGDNTFTNKGSITGTVSAKEGN

SEQ ID NO: 593 - protein, 19 aa, Escherichia coli
STLTGEVTAGNGNNNVTLN

SEQ ID NO: 594 - protein, 23 aa, Escherichia coli
KTHVDQVTAGTGKNTFTIKGEGA

SEQ ID NO: 595 - protein, 10 aa, Escherichia coli
LDGGQGDSDS

SEQ ID NO: 596 - protein, 14 aa, Escherichia coli
DGGNGPGSVDIESG

SEQ ID NO: 597 - protein, 7 aa, Escherichia coli
LDADTSA

SEQ ID NO: 598 - protein, 11 aa, Escherichia coli
NITTVGSGVQQ

SEQ ID NO: 599 - protein, 18 aa, Escherichia coli
MPGDTIASNSIETSAAGT

SEQ ID NO: 600 - protein, 7 aa, Escherichia coli
LEQDDAQ

SEQ ID NO: 601 - protein, 8 aa, Escherichia coli
GTVTGTGG

SEQ ID NO: 602 - protein, 7 aa, Escherichia coli
ENGQAIS

SEQ ID NO: 603 - protein, 15 aa, Escherichia coli
TFDVTQGGEVVAQGN

SEQ ID NO: 604 - protein, 6 aa, Escherichia coli
SDGIKG

SEQ ID NO: 605 - protein, 6 aa, Escherichia coli
LQGTGD

SEQ ID NO: 606 - protein, 10 aa, Escherichia coli
RANAQGLQTD

SEQ ID NO: 607 - protein, 7 aa, Escherichia coli
GAQLTGA

SEQ ID NO: 608 - protein, 13 aa, Escherichia coli
SNGGNNYTGDTLV

SEQ ID NO: 609 - protein, 14 aa, Escherichia coli
GYSQTVGALQTETG

SEQ ID NO: 610 - protein, 14 aa, Escherichia coli
SGTQRQPGDDNGGI

SEQ ID NO: 611 - protein, 10 aa, Escherichia coli
AQGLGSQGSI

SEQ ID NO: 612 - protein, 9 aa, Escherichia coli
ADGSGVSSN

SEQ ID NO: 613 - protein, 9 aa, Escherichia coli
SKSLSGEGS

SEQ ID NO: 614 - protein, 10 aa, Escherichia coli
TLSGDNSNFS

SEQ ID NO: 615 - protein, 9 aa, Escherichia coli
TYTGDTTVE

SEQ ID NO: 616 - protein, 13 aa, Escherichia coli
DSVTRAAGATLSG

SEQ ID NO: 617 - protein, 11 aa, Escherichia coli
TVSGQVNNQGT

SEQ ID NO: 618 - protein, 7 aa, Escherichia coli
GYETAEV

SEQ ID NO: 619 - protein, 17 aa, Escherichia coli
GGKTGNTLTVNGDYTGG

SEQ ID NO: 620 - protein, 7 aa, Escherichia coli
GDDTSTT

SEQ ID NO: 621 - protein, 8 aa, Escherichia coli
NTSGDTGV

SEQ ID NO: 622 - protein, 10 aa, Escherichia coli
VRGQGAQTAD

SEQ ID NO: 623 - protein, 8 aa, Escherichia coli
GGQSDGNF

SEQ ID NO: 624 - protein, 11 aa, Escherichia coli
GNAGGTDGNWY

SEQ ID NO: 625 - protein, 48 aa, Escherichia coli
ELPPEPQPQPQPQPQPQPQPQPQPQPQPQPHPTPDKPVQKVYRPEAGS

SEQ ID NO: 626 - protein, 8 aa, Escherichia coli
DREGETYY

SEQ ID NO: 627 - protein, 7 aa, Escherichia coli
FTGEKKA

SEQ ID NO: 628 - protein, 13 aa, Escherichia coli
NRWKDSSSQLNTQ

SEQ ID NO: 629 - protein, 10 aa, Escherichia coli
AQWTDGQDRL

SEQ ID NO: 630 - protein, 25 aa, Escherichia coli
GYGNEKSSTTSSLSGYKSKGAINGY

SEQ ID NO: 631 - protein, 14 aa, Escherichia coli
GTWQQNDGNDNGAY

SEQ ID NO: 632 - protein, 24 aa, Escherichia coli
TVNGEKLAAESWKSRGFTGSVEAG

SEQ ID NO: 633 - protein, 10 aa, Escherichia coli
GEFTGSQGSH

SEQ ID NO: 634 - protein, 21 aa, Escherichia coli
ASEHTEKNGTKVQLSGDGNIQ

SEQ ID NO: 635 - protein, 13 aa, Escherichia coli
KGKSASDDNKAHQ

SEQ ID NO: 636 - protein, 13 aa, Escherichia coli
TALSQDGATNIAE

SEQ ID NO: 637 - protein, 8 aa, Escherichia coli
TGVQGKLS

SEQ ID NO: 638 - protein, 11 aa, Escherichia coli
GVQAGDKGYSD

SEQ ID NO: 639 - DNA, 624 bp, Escherichia coli
gataagttttttggcagcaaatttacagatatcttccatggcgcggatggtgatgaccacatagaaggaaatgatgggaatgaccgcttatatggtgataaaggtaatgacacactgaggggcggaaacggggatgaccagctctatggcggtgatggtaacgataagctaaccggaggtgtgggtaataactaccttaatggcggagacggggatgatgagcttcaggttcagggtaattctcttgctaaaaatgtattatccggtggaaaaggtaatgacaagctgtacggcagtgagggggcagatctgcttgatggcggagaagggaatgatctcctgaagggggggtatggtaatgatatttatcgttatctttcaggatatggccatcatattattgacgatgatgggggaaaagacgataaactcagtttggctgatattgatttccgggacgttgcctttaagcgagaaggaaatgacctcatcatgtataaagctgaaggtaatgttctttccattggtcataaaaatggtattacattcaggaactggtttgaaaaagagtcaggtgatatctctaatcaccagatagagcagatttttgataaagatggccgg

SEQ ID NO: 640 - protein, 208 aa, Escherichia coli
DKFFGSKFTDIFHGADGDDHIEGNDGNDRLYGDKGNDTLRGGNGDDQLYGGDGNDKLTGGVGNNYLNGGDGDDELQVQGNSLAKNVLSGGKGNDKLYGSEGADLLDGGEGNDLLKGGYGNDIYRYLSGYGHHIIDDDGGKDDKLSLADIDFRDVAFKREGNDLIMYKAEGNVLSIGHKNGITFRNWFEKESGDISNHQIEQIFDKDGR

SEQ ID NO: 641 - DNA, 1242 bp, Escherichia coli
gttgctgatggtcagcaagcctacacgctgacactgacagcggtggactccgagggtaatccggtgacgggagaagccagccgcctgcgacttgttccgcaagacactaatggtgtaaccgttggtgccatttcggaaataaaaccaggggtttacagcgccacggtttcttcgacccgtgccggaaacgttgttgtgcgtgccttcagcgagcagtatcagctgggcacattacaacaaacgctgaagtttgttgccgggccgcttgatgcagcacattcgtccatcacactgaatcctgataaaccggtggttggcggtacagttacggcaatctggacggcaaaagatgctaatgacaaccctgtaactggcctcaatccggatgcaccgtcattatcgggcgcagctgctgctggttctacggcatcaggctggacggataatggcgacgggacctggactgcgcagatttctctcggcactacggcgggtgaattagacgttatgccgaagctcaatgggcaggacgcggcagcaaatgcggcaaaagtaaccgtggtggctgatgcattatcttcaaaccagtcgaaagtctctgtcgcagaagatcacgtaaaagccggtgaaagcacaaccgtaacgctggtggcgaaagatgcgcatggcaacgctatcagtggtctttcgttgtcggcaagtttgacggggaccgcctctgaaggggcgaccgtttccagttggaccgaaaaaggtgacggttcctatgttgctacgttaactacaggcggaaagacgggcgagcttcgtgtcatgccgctcttcaacggccagcctgcagccaccgaagccgcgcagctgactgttattgccggagagatgtcatcagcgaactctacgcttgttgcggacaataaaactccaacggttaaaacgacgacggaactcaccttcaccatgaaggatgcgtacgggaatccggtcaccgggctgaagccagatgcaccagtgtttagtggtgccgccagcacggggagtgagcgtccttcagcaggaaactggacagagaaaggtaatggggtctacgtgtcgaccttaacgctgggatctgccgcgggtcagttgtctgtgatgccgcgagtgaacggccaaaatgccgttgctcagccactggtgctgaatgttgcaggtgacgcatctaaggctgagattcgtgatatgacagtgaaggttaataaccaa

SEQ ID NO: 642 - protein, 414 aa, Escherichia coli
VADGQQAYTLTLTAVDSEGNPVTGEASRLRLVPQDTNGVTVGAISEIKPGVYSATVSSTRAGNVVVRAFSEQYQLGTLQQTLKFVAGPLDAAHSSITLNPDKPVVGGTVTAIWTAKDANDNPVTGLNPDAPSLSGAAAAGSTASGWTDNGDGTWTAQISLGTTAGELDVMPKLNGQDAAANAAKVTVVADALSSNQSKVSVAEDHVKAGESTTVTLVAKDAHGNAISGLSLSASLTGTASEGATVSSWTEKGDGSYVATLTTGGKTGELRVMPLFNGQPAATEAAQLTVIAGEMSSANSTLVADNKTPTVKTTTELTFTMKDAYGNPVTGLKPDAPVFSGAASTGSERPSAGNWTEKGNGVYVSTLTLGSAAGQLSVMPRVNGQNAVAQPLVLNVAGDASKAEIRDMTVKVNNQ

SEQ ID NO: 643 - DNA, 1542 bp, Escherichia coli
attaattgcaataacgcaatggcagatgtcatattgtcaccagactggcgtccgggtacgaataactcgggtgttggggctgcaacagtaagtggtaaaaccgaatacatcactggtccaaatgtcgtccagtctggtgggtcaggtcttatctggatgactgtagaacaggcaattttaaatggctacaccactggagataatttatccggattgatttacgtcaataccggagaaaaaacaaaaaccattacagtgaaggatgaggttactggcgcttctcaaacacttcaagtgtttgatactgactctttctcacaacgcgatgcggggactgggggaaatgaaaccattcctggttttagtggcactgcggattttttcaatgcgacacgttttgtaacagccaataatggcggtacagctattttggatgtgggttcaccagcaatcggtaatttttttaaaaatacacagcttgctgtagctgatggagaaggttcctctgttgtatggaactcggtcaatgatttttattttcagcctggtgcaaccatgcaggggggcggcgttactcaaaaaatcattgactcaatgaaatatgctggaacaattactgattgggcgggaaaagtacaccatattaactctcttgatgatttaaagcaatataatcaatatttgataaagtcactagaggacaaaacgctttcttataagcagtatgatgctgaatttaataaggcccttattgtcaccaagcataattacaatgtggatatgaccgctgggggacgtatagactcaactccttacaaagaaaatgtagggctgcttgctgttctccatgcaaccaataacgcacgagcaatattaggtaaaacgggtaaattaactggagttcttcctgcctatgggaatggaggagggatcgttgcaactaatggtgggaccggtgttaatgaaggggtcattgatgccattggtactgaaatgattgcctatcaagacagtaccattgttaacgatggtacactttttgtttgggataataatgataaatatgctctccaggcagaggggatggttgccggtagtaatggttcttcagccattaataatggtgttattaatattcgcccatttaaaaatgctttcgctccagaggggattaacaccgcaattgttgttagtaatgggggcatggcaacaaataaaggcacaataaatattactgccgatgcatcaactaatgataataatggcaaaacacgaggtgtaaatgttggagctggaggctcttttattaactcggccttcgggagcatcaatgtaggtattgcggaggataaaactgcgactcattcggctgtgggttctgttgcgattgaagtacaaaatggtgcaaacaaagtcgttaatgaaggtactatttttttgggcaggggggctcaggggaactacggaatcctggcaaaggatgccgggactgttgatgtggtaaataaagggactatcactattgacggtcatgacagtgat

SEQ ID NO: 644 - protein, 514 aa, Escherichia coli
INCNNAMADVILSPDWRPGTNNSGVGAATVSGKTEYITGPNVVQSGGSGLIWMTVEQAILNGYTTGDNLSGLIYVNTGEKTKTITVKDEVTGASQTLQVFDTDSFSQRDAGTGGNETIPGFSGTADFFNATRFVTANNGGTAILDVGSPAIGNFFKNTQLAVADGEGSSVVWNSVNDFYFQPGATMQGGGVTQKIIDSMKYAGTITDWAGKVHHINSLDDLKQYNQYLIKSLEDKTLSYKQYDAEFNKALIVTKHNYNVDMTAGGRIDSTPYKENVGLLAVLHATNNARAILGKTGKLTGVLPAYGNGGGIVATNGGTGVNEGVIDAIGTEMIAYQDSTIVNDGTLFVWDNNDKYALQAEGMVAGSNGSSAINNGVINIRPFKNAFAPEGINTAIVVSNGGMATNKGTINITADASTNDNNGKTRGVNVGAGGSFINSAFGSINVGIAEDKTATHSAVGSVAIEVQNGANKVVNEGTIFLGRGAQGNYGILAKDAGTVDVVNKGTITIDGHDSD

SEQ ID NO: 645 - DNA, 1263 bp, Escherichia coli
gcacctgcactgaatgttggcatgctggcaaataatagctccgggatgaaaaactccgggattatcaatgttaatggtctgaacagcaccgggctacaggtaatcaatgcaggacagttgaattctgacggtacgataaatgttggcggcaagggtatcagtagtggtttccgtaactatggtgcctgggtggaaggtgccggaagcaatgttaatgtatccggaaaaatcagtcttgccggtacgggggctgtgggggtttttgctaaagatggcggcagtctgaccctgtcaggcaatggtgcagtgctatttggcagcagcgatcagataggcttttatgtctatggaaaggactctgccattcataataccggaagcggtgttatggatgtgtccactgaaaactcaacattattccgtattgccagtggtgcgacattccagggaactgcagatgcttcttctgcacttacggcgtctggtaagaactcttatgcacttattgccacggggaaatcggatggcggtgtggcctcgacagtaacgtctggaggaatgaccatcaacctgacgggtgagggggctacagcgactttaattgaagggggagcgcagggcacaattgaaagtaatgccattatcaatatggataatgccagtgcgatagccggtattgcggatggcaatggctatgatatttccggcaaactcattaatccgaaggacaagaccacactattaacggcgggggctcagttaagttccacccaggataaagtgaccgggtatatcgcccgtaatggggccactctaaataataccggtaatatcatctttactggaaagaatacagtgggcgtccgggttgaggagggggctgttggtaccaacagcggaaatattacagttcaggatggtggtgtgggactaattgctaatgccacacaagatgttacaacgattaataactcgggaaatctcgttctcaagggaggagataatgctaaccgtacaacgggtataaaagcatctggtacaacaacaacggttaatatgaccgcgggtactatatctttgcagggacagggggcgattggcgttgaggccagcaataaagggactgttaaccttgatggttcggcagtaccgaactttgctgctgacggctctggtattaccgatcagattgcttttcgtattatcggagatggtgcaaccattaagacgaatattgcaccgggaactctgctggatgccagt

SEQ ID NO: 646 - protein, 421 aa, Escherichia coli
APALNVGMLANNSSGMKNSGIINVNGLNSTGLQVINAGQLNSDGTINVGGKGISSGFRNYGAWVEGAGSNVNVSGKISLAGTGAVGVFAKDGGSLTLSGNGAVLFGSSDQIGFYVYGKDSAIHNTGSGVMDVSTENSTLFRIASGATFQGTADASSALTASGKNSYALIATGKSDGGVASTVTSGGMTINLTGEGATATLIEGGAQGTIESNAIINMDNASAIAGIADGNGYDISGKLINPKDKTTLLTAGAQLSSTQDKVTGYIARNGATLNNTGNIIFTGKNTVGVRVEEGAVGTNSGNITVQDGGVGLIANATQDVTTINNSGNLVLKGGDNANRTTGIKASGTTTTVNMTAGTISLQGQGAIGVEASNKGTVNLDGSAVPNFAADGSGITDQIAFRIIGDGATIKTNIAPGTLLDAS

SEQ ID NO: 647 - DNA, 1536 bp, Escherichia coli
ggggaacgttctgtacttttccgtattgaagatggggcaaaacaggccggctctctgctgatgaaaacctccgggacaggcagccgtggtatctgggccacagggaaagggagcaatgtcctggctgatgctggcagtgatttccagatcctgggcgctcaggctcagggattatatgtaactggtggtgcgacagcgacgctgaaacagggggcatcagttaaccttgtaggggatggcgctgttgtcgcggaagttgacggaaatgaatacgctctggatggcagtattacacaaacgaatactggctcggttattaccaatgaggcagatatctcttcgccgctgaataatgccaagggctttattacgcgtaatcagggactgttgattaacaacggcaacattgatttcactaccggtacagataatatcggcgtctgggttgataacggccgctttgaaaatacaggaagccgtattgcggtcaatggcgttgcattatttgttgaaggtgcacagtctcagattaccagcacaggaggggatatcgtcgctgtggatggtgaggctgccattaagctgggggcgggcgcgtcactgaacctggcagggagtggcttgggtacgatcgaaggtcagaaaaatgcgcatggcatcctgctggatacaggggctgtggggctggttattgatggtgcgaaaatcaatgttaatgctgcaggtgcggtcggtcacgggattgagaaccgcgcagaaattgaaggcattcagttaaccaatacgactgaaattaatgtggctgatggcattggtgtacgtacttctgcctccctggccaagaccaacagcggcactattaatgtagacggcagtggaattgcactggcgttccagaaagctgacggaagtgaaaccgataataacctggatatgtctgactccgctggattggtcattaacctgaagggtacggacggcacgggtattttcgccaacactaaagatggtgctgtcgtgaagagtggtgcaagtgtcaatgttatacaggccgatggcggttccgctctggtggttaacaatgcagccagtgaagtggttcagagcggtaatctcatctctgcttctctgagtcatgccgtagtggatgcttcaaaagcacaatcctttaccaataaaggtcagattaaagctgcgtccaccaccgggactgcaatggcgtttgatgacgccgtgaataccaccgtactgaatgacagcggtgctgaaattcagggggttgtggctctgaacggcggtgataacacattcaccaataaaggcagtattaccggaaccgtcagtgcgaaagagggtaacaatacatttttatttgatgatggcagcacactgacaggagaagtgactgcaggaaatggcaataataatgtaacactcaatggtaagactcatgttgatcaggttactgccggtaccgggaagaacaccttcaccattaaaggtgaaggggcaacctggaacctgctggatggcggg

SEQ ID NO: 648 - protein, 512 aa, Escherichia coli
GERSVLFRIEDGAKQAGSLLMKTSGTGSRGIWATGKGSNVLADAGSDFQILGAQAQGLYVTGGATATLKQGASVNLVGDGAVVAEVDGNEYALDGSITQTNTGSVITNEADISSPLNNAKGFITRNQGLLINNGNIDFTTGTDNIGVWVDNGRFENTGSRIAVNGVALFVEGAQSQITSTGGDIVAVDGEAAIKLGAGASLNLAGSGLGTIEGQKNAHGILLDTGAVGLVIDGAKINVNAAGAVGHGIENRAEIEGIQLTNTTEINVADGIGVRTSASLAKTNSGTINVDGSGIALAFQKADGSETDNNLDMSDSAGLVINLKGTDGTGIFANTKDGAVVKSGASVNVIQADGGSALVVNNAASEVVQSGNLISASLSHAVVDASKAQSFTNKGQIKAASTTGTAMAFDDAVNTTVLNDSGAEIQGVVALNGGDNTFTNKGSITGTVSAKEGNNTFLFDDGSTLTGEVTAGNGNNNVTLNGKTHVDQVTAGTGKNTFTIKGEGATWNLLDGG

SEQ ID NO: 649 - DNA, 1143 bp, Escherichia coli
cagggagattctgattccctgatttttgataacgccattcatacgctggattctgttgtaaaactacagaatttcgaacatgtcgggctgaagaacagttcacttgtcactctgaaggaagctcttgtgctgaccgatggggggaacggtccgggttccgtcgatattgaatcgggcagcgaactggccattattcccgcagttgcaggcaactttacctttgatccactgttaacaggcaaaggaacactgtctgcccgtcttgatgccgacacatctgcttttgaattcagccataacgtcggggatcaatttgccggaactctgaagctgggtactagtagctttgctctggaagggctgaatacgagcgggttaacccatgcaatgctgatgtctgaaaccgggaatatcacaacggttggctccggtgttcagcagattggcggtcttgggttcaatggcggaacgctgatttttggttccgttatgccgggcgataccattgccagcaacagtattgaaacctctgctgcaggtacgctggatatccgggggaaaggcacaattcaggtcaccatgccagatgaagtgattaatgatattccggctgttgatacccgtaagaatttgctggagcaggatgatgcgcagaccctggtcacgctggtgaatgcagcgggtaccgtcaccggtactggcgggcaactgcaactggtggatgaaaacgggcaggctatttctcacagtcagacgtttgatgtcactcagggcggtgaagttgtagctcagggaaattatgactataagctgctgggaagctccgacggtattaaaggtgacggactgtacataggctatgggctgaagtcgctggatttacagggaaccggtgataaagcgctggtgctgacaccgagagcgaatgcccagggactgcagacagatcttggcgcacagttaacgggggcaggggatctggccatcgaagctgcggggcaggttgtcacactgtctaacggcggtaataactacaccggggatacgctggtgcgcagcggcacattacagatggcaaatgataatgtacttggcgcaacaggtaatctgaacgtcgccagcaatgccgtcttcagaacaaac

SEQ ID NO: 650 - protein, 381 aa, Escherichia coli
QGDSDSLIFDNAIHTLDSVVKLQNFEHVGLKNSSLVTLKEALVLTDGGNGPGSVDIESGSELAIIPAVAGNFTFDPLLTGKGTLSARLDADTSAFEFSHNVGDQFAGTLKLGTSSFALEGLNTSGLTHAMLMSETGNITTVGSGVQQIGGLGFNGGTLIFGSVMPGDTIASNSIETSAAGTLDIRGKGTIQVTMPDEVINDIPAVDTRKNLLEQDDAQTLVTLVNAAGTVTGTGGQLQLVDENGQAISHSQTFDVTQGGEVVAQGNYDYKLLGSSDGIKGDGLYIGYGLKSLDLQGTGDKALVLTPRANAQGLQTDLGAQLTGAGDLAIEAAGQVVTLSNGGNNYTGDTLVRSGTLQMANDNVLGATGNLNVASNAVFRTN

SEQ ID NO: 651 - DNA, 1704 bp, Escherichia coli
gctgacacggttgtacaggcgggagaaaccgtgaacggcggaacactgacaaatcatgacaaccagattgtcctcggtacggccaacggaatgaccatcagtaccgggctggagtatgggccggataacgaggccaataccggcgggcaatggatacaaaatggcggtatcgccaacaacactactgtcaccggtggtggtcttcagagagtgaatgccggaggaagcgtttcagacacggttatcagtgccggaggcggacagagccttcaggggcaggcagtgaacaccactctgaacggcggtgagcagtgggtacatgaaggcgggattgcaacgggtaccgtcattaatgagaagggctggcaggccgtcaaatccggtgcaatggcaaccgacacggttgtgaataccggcgcggaaggaggaccggatgcggaaaatggtgataccgggcagaccgtctacggagatgccgtacgcaccaccatcaataaaaatggtcgtcagattgtggctgctgaaggaacggcaaataccactgtggtttatgccggcggcgaccagactgtacatggtcacgcactggataccacgctgaatggggggtaccagtatgtgcacaacggaggtacagcatctgacactgttgttaacagtgacggctggcagattatcaaggaaggtggtctggcggatttcaccaccgttaaccagaaaggtaaactgcaggtgaacgccggtggtacagccacgaatgtcaccctgacgcagggcggcgcactggtcaccagtacggcggcaaccgtcaccggcagcaaccgtctgggcaatttcactgtggaaaacggtaatgctgacggtgttgttctggagtccggtggtcgcctggatgtactggagggccattcagcctggaaaacactggtggatgacggcggtaccctggcagtgtctgccggtggtaaggcaacagatgtcaccatgacatccggtggtgccctgattgcagacagtggtgccactgttgaggggaccaatgccagcggtaagttcagtattgatggcatatccggtcaggccagcggcctgctgctggaaaatggcggcagctttacggttaatgccggaggactggccagcaacaccactgtcggacatcgtggaacactgacgctggccgccgggggaagtctgagtggcagaacacagctcagtaaaggcgccagtatggtactgaatggtgatgtggtcagtaccggcgatattgttaacgccggagagattcgctttgataatcagacgacaccggatgccgcactgagccgtgctgttgcaaaaggcgactccccggtaacgttccataaactgaccaccagtaacctcaccggtcagggtggcaccatcaatatgcgtgttcgccttgatggcagcaatgcctctgaccagctggtgattaatggtggtcaggcaaccggcaaaacctggcttgcgtttacaaatgtcggaaacagtaacctcggggtggcaacctccggacagggtatccgggttgtggatgcacagaatggtgccaccacagaagaaggtgcgtttgccctgagtcgcccgcttcaggccggcgcctttaactacaccctgaaccgtgacagcgatgaagactggtacctgcgcagtgaaaatgcttatcgtgctgaagtcccc

SEQ ID NO: 652 - protein, 568 aa, Escherichia coli
ADTVVQAGETVNGGTLTNHDNQIVLGTANGMTISTGLEYGPDNEANTGGQWIQNGGIANNTTVTGGGLQRVNAGGSVSDTVISAGGGQSLQGQAVNTTLNGGEQWVHEGGIATGTVINEKGWQAVKSGAMATDTVVNTGAEGGPDAENGDTGQTVYGDAVRTTINKNGRQIVAAEGTANTTVVYAGGDQTVHGHALDTTLNGGYQYVHNGGTASDTVVNSDGWQIIKEGGLADFTTVNQKGKLQVNAGGTATNVTLTQGGALVTSTAATVTGSNRLGNFTVENGNADGVVLESGGRLDVLEGHSAWKTLVDDGGTLAVSAGGKATDVTMTSGGALIADSGATVEGTNASGKFSIDGISGQASGLLLENGGSFTVNAGGLASNTTVGHRGTLTLAAGGSLSGRTQLSKGASMVLNGDVVSTGDIVNAGEIRFDNQTTPDAALSRAVAKGDSPVTFHKLTTSNLTGQGGTINMRVRLDGSNASDQLVINGGQATGKTWLAFTNVGNSNLGVATSGQGIRVVDAQNGATTEEGAFALSRPLQAGAFNYTLNRDSDEDWYLRSENAYRAEVP

SEQ ID NO: 653 - protein, 490 aa, Escherichia coli
MKKSLLAVMLTGLFALVSLPALGNVNLEQLKQKAESGEAKAQLELGYRYFQGNETTKDLTQAMDWFRRAAEQGYTPAEYVLGLRYMNGEGVPQDYAQAVIWYKKAALKGLPQAQQNLGVMYHEGNGVKVDKAESVKWFRLAAEQGRDSGQQSMGDAYFEGDGVTRDYVMAREWYSKAAEQGNVWSCNQLGYMYSRGLGVERNDAISAQWYRKSATSGDELGQLHLADMYYFGIGVTQDYTQSRVLFSQSAEQGNSIAQFRLGYILEQGLAGAKEPLKALEWYRKSAEQGNSDGQYYLAHLYDKGAEGVAKNREQAISWYTKSAEQGDATAQANLGAIYFRLGSEEEHKKAVEWFRKAAAKGEKAAQFNLGNALLQGKGVKKDEQQAAIWMRKAAEQGLSAAQVQLGEIYYYGLGVERDYVQAWAWFDTASTNDMNLFGTENRNITEKKLTAKQLQQAELLSQQYIEKYAPEAWARMQKLKAQSAVKTGNK

SEQ ID NO: 654 - protein, 490 aa, Escherichia coli
MKKSLLAVMLTGLFALVSLPALGNVNLEQLKQKAESGEAKAQLELGYRYFQGNETTKDLTLAMDWFRRAAEQGYTPAEYVLGLRYMNGEGVPQDYAQAVIWYKKAALKGLPQAQQNLGVMYHEGNGVKVDKAESVKWFRLAAEQGRDSGQQSMGDAYFEGDGVTRDYVMAREWYSKAAEQGNVWSCNQLGYMYSRGLGVERNDAISAQWYRKSATSGDELGQLHLADMYYFGIGVTQDYTQSRVLFSQSAEQGNSIAQFRLGYILEQGLAGAKEPLKALEWYRKSAEQGNSDGQYYLAHLYDKGAEGVAKNREQAISWYTKSAEQGDATAQANLGAIYFRLGSEEEHKKAVEWFRKAAAKGEKAAQFNLGNALLQGKGVKKDEQQAAIWMRKAAEQGLSAAQVQLGEIYYYGLGVERDYVQAWAWFDTASTNDMNLFGTENRNITEKKLTTKQLQQAELLSQQYIEKYATEAWARMQKLKAQSAVKTGNK

SEQ ID NO: 655 - protein, 490 aa, Escherichia fergusonii
MKKSLLAALLTGLFALVSLPALGNVNFEQLKQKAERGEAKAQLELGYRYFQGNETTKDLTQAIDWFRRAAEQGYTPAEFVLGLRYMNGEGVPKDYAQAVIWYKKAALKGLPQAQQNLGVMYHDGKGVKIDKAESVKWFRLAAEQGRDSGQQSMGDAYFEGDGVTRDYVMAREWYSKAAEQGNVWSCNQLGYIYSKGLGVEKNDAISAQWYRKSATSGDELGQLHLADMYYFGIGVTQDYTQSRILFTQSAEQGNAIAQYRLGYILEEGLAGAKEPLKALEWYRKSAEQGNAIGQYYLAEIYIRRAEGIPYNREQAIYWYTKSAEQGDTDAQVNLGALLYRHGSEEEQRRAVDWYRKAAEEGVAMAQFNLGNALLQGKGVKKDEQQAAIWMRKAAEQGFSSAQVQLGEIYYYGLGVERDYVQAWAWFDTASTNDMNLFGTENRNITEKKLTAKQLQQAELLSQQYIEKYAPEAWARMQKLNARSTVTTGNK

SEQ ID NO: 656 - protein, 17 aa, Escherichia coli
LTGLFALVSLPALGNVN

SEQ ID NO: 657 - protein, 24 aa, Escherichia coli
GEAKAQLELGYRYFQGNETTKDLT

SEQ ID NO: 658 - protein, 29 aa, Escherichia coli
DYAQAVIWYKKAALKGLPQAQQNLGVMYH

SEQ ID NO: 659 - protein, 62 aa, Escherichia coli
DKAESVKWFRLAAEQGRDSGQQSMGDAYFEGDGVTRDYVMAREWYSKAAEQGNVWSCNQLGY

SEQ ID NO: 660 - protein, 42 aa, Escherichia coli
NDAISAQWYRKSATSGDELGQLHLADMYYFGIGVTQDYTQSR

SEQ ID NO: 661 - protein, 23 aa, Escherichia coli
GLAGAKEPLKALEWYRKSAEQGN

SEQ ID NO: 662 - protein, 33 aa, Escherichia coli
AQFNLGNALLQGKGVKKDEQQAAIWMRKAAEQG

SEQ ID NO: 663 - protein, 50 aa, Escherichia coli
AQVQLGEIYYYGLGVERDYVQAWAWFDTASTNDMNLFGTENRNITEKKLT

SEQ ID NO: 664 - protein, 18 aa, Escherichia coli
KQLQQAELLSQQYIEKYA

SEQ ID NO: 665 - protein, 11 aa, Escherichia coli
FQGNETTKDLT

SEQ ID NO: 666 - protein, 8 aa, Escherichia coli
AEQGYTPA

SEQ ID NO: 667 - protein, 9 aa, Escherichia coli
  misc_feature 6: 'X' is K/Q
GEGVPXDYA

SEQ ID NO: 668 - protein, 6 aa, Escherichia coli
LPQAQQ

SEQ ID NO: 669 - protein, 22 aa, Escherichia coli
EQGRDSGQQSMGDAYFEGDGVT

SEQ ID NO: 670 - protein, 9 aa, Escherichia coli
SKAAEQGNV

SEQ ID NO: 671 - protein, 11 aa, Escherichia coli
YRKSATSGDEL

SEQ ID NO: 672 - protein, 5 aa, Escherichia coli
TQDYT

SEQ ID NO: 673 - protein, 8 aa, Escherichia coli
LAGAKEPL

SEQ ID NO: 674 - protein, 8 aa, Escherichia coli
GVKKDEQQ

SEQ ID NO: 675 - protein, 5 aa, Escherichia coli
TASTN

SEQ ID NO: 676 - protein, 5 aa, Escherichia coli
NRNIT

SEQ ID NO: 677 - DNA, 2964 bp, Escherichia coli
tgcgtggcgtgggcaaatatctctgttcaggttctttttccactcgctgtcacctttacgccagtaatggcagcacgtgcgcagcatgcggttcagccacggttgagcatggaaaatactacggtaactgctgataataacgtggagaaaaatgtcgcgtcgcttgccgctaatgccgggacatttttaagcagtcagccagatagcgatgcgacacgtaactttattaccggaatggccaccgctaaagctaaccaggaaattcaggagtggctcgggaaatacggtactgcgcgcgtcaaactgaatgtcgataaaaatttctcgctgaaggactcttcgctggaaatgctttatccgatttatgatacaccgacaaatatgttgttcactcagggggcaatacatcgtaccgacgatcgtactcagtcaaatattggttttggctggcgtcatttttcagaaaatgactggatggcgggggtgaatacttttatcgatcatgatttatcccgtagtcatacccgcattggtgttggtgcggaatactggcgtgattatttgaaactgagcgccaatggttatatccgggcttctggctggaaaaaatcgccggatgttgaggattatcaggaacgcccggcgaatggctgggatattcgtgctgagggctatttacctgcctggccgcagcttggcgcaagcctgatgtatgaacagtattatggcgatgaagtcgggctgtttggtaaagataaacgccagaaagatccacatgcgattaccgctgaagtgaattacacgccagtgcctcttctgaccctgagtgccgggcataagcagggcaagagtggtgagaatgacactcgctttggcctggaagttaattatcggattggcgaacctctggaaaaacaactcgatacagacagcattcgcgagcgtcgaatgctggcaggcagccgctatgacctggttgagcgtaataacaatatcgttcttgagtatcgcaaatctgaagtgatccgtattgctctgcctgagcgtattgaaggcaagggcggccagacggtttccctggggcttgtggtcagcaaagcaactcacggtctgaaaaatgtgcaatgggaagcgccgtctttgctggccgcaggcggaaaaattacggggcagggcaatcagtggcaagtgacgctcccggcttatcaggcaggcaaagacaattattatgcgatttcagcgattgcctacgataacaaaggcaatgcctcgaaacgtgtgcagacagaagtagttattagcggagctggtatgagcgccgatcgtacggcgttaacgcttgacggtcagagccgtattcaaatgcttgctaacggtaatgagcaaaagccgctggtgctgtctctgcgcgacgccgagggccagccagtcacgggcatgaaagatcagatcaagactgaactaaccttcaaaccggctggaaatattgtgactcgtaccctgaaggccactaaatcacaggcaaagccaacactgggtgagttcaccgaaactgaagcaggggtgtatcagtctgtctttactaccggaacgcagtcaggtgaggcaacgattactgttagcgttgatgacatgagcaaaactgtcactgcagaactgcgggccacgatgatggatgtgtcaaactccaccctgagtgctaacgagccgtcaggtgatgtggttgctgatggtcagcaagcctacacgctgacactgacagcggtggactccgagggtaatccggtgacgggagaagccagccgcctgcgacttgttccgcaagacactaatggtgtaaccgttggtgccatttcggaaataaaaccaggggtttacagcgccacggtttcttcgacccgtgccggaaacgttgttgtgcgtgccttcagcgagcagtatcagctgggcacattacaacaaacgctgaagtttgttgccgggccgcttgatgcagcacattcgtccatcacactgaatcctgataaaccggtggttggcggtacagttacggcaatctggacggcaaaagatgctaatgacaaccctgtaactggcctcaatccggatgcaccgtcattatcgggcgcagctgctgctggttctacggcatcaggctggacggataatggcgacgggacctggactgcgcagatttctctcggcactacggcgggtgaattagacgttatgccgaagctcaatgggcaggacgcggcagcaaatgcggcaaaagtaaccgtggtggctgatgcattatcttcaaaccagtcgaaagtctctgtcgcagaagatcacgtaaaagccggtgaaagcacaaccgtaacgctggtggcgaaagatgcgcatggcaacgctatcagtggtctttcgttgtcggcaagtttgacggggaccgcctctgaaggggcgaccgtttccagttggaccgaaaaaggtgacggttcctatgttgctacgttaactacaggcggaaagacgggcgagcttcgtgtcatgccgctcttcaacggccagcctgcagccaccgaagccgcgcagctgactgttattgccggagagatgtcatcagcgaactctacgcttgttgcggacaataaaactccaacggttaaaacgacgacggaactcaccttcaccatgaaggatgcgtacgggaatccggtcaccgggctgaagccagatgcaccagtgtttagtggtgccgccagcacggggagtgagcgtccttcagcaggaaactggacagagaaaggtaatggggtctacgtgtcgaccttaacgctgggatctgccgcgggtcagttgtctgtgatgccgcgagtgaacggccaaaatgccgttgctcagccactggtgctgaatgttgcaggtgacgcatctaaggctgagattcgtgatatgacagtgaaggttaataaccaa

SEQ ID NO: 678 - DNA, 1224 bp, Escherichia coli
ctggctaatggacagtctgctaaccagatcaccctgaccgtcgtggacagctatggtaacccgttgcaggggcaagaagttacgctgactttaccgcagggtgtgaccagcaagacggggaatacagtaacaaccaatgcggcagggaaagtggacattgagcttatgtcaacggttgcaggggaacttgagatcgaggcctcggtgaaaaactctcagaagacggtcaaggtgaaattcaaggcggatttcagtaccggtcaggcgagcctggaggtagacgccgctgctcaaaaagtggcaaacggcaaagatgcctttacgctgacggcaacggttaaggatcaatacggcaaccttcttcctggcgctgtggtcgtctttaatctgcctcggggcgtcaaaccgcttgcagacggtaatatcatggtgaacgccgacaaggagggtaaagcggaactgaaagtggtttccgtgactgccggaacctatgagatcacggcgtcagcaggaaatgaccagccttcgaatgcgcagtctgtaacgtttgtggctgataagactacggcgaccatctccagtattgaggtgattggcaaccgtgcagtggcggacggcaaaaccaaacagacgtataaagttacggtgactgatgccaataacaacctgctgaaagatagcgaagtgacgctgactgccagcccggaaaatttagttctgactcccaatgggacggcgacaacgaatgagcaagggcaggctattttcaccgccacgaccactgtcgcagcgacatatacactcacggcgaaagtggaacaggccgacggtcaggaatcgacgaaaactgccgaatctaaattcgtcgcggatgataaaaacgcggtgctcgctgcatctccagagcgtgtagattctctggtggcggacgggaagactactgcaacactgacggttactctgatgtcgggtgtcaaccccgtaggaggaaccatgtgggtcgacattgaggctccggaaggggtgacagaggcggattatcagttcctgccgtcgaaaaatgaccatttcgcgagcgggaaaatcacgcgtacatttagtaccaacaagccaggtacatacacattcacattcaactctttgacatatggagggtatgaaatgaaaccagtgactgtgacaattaacgccgttcctgcagatactgaaggcgctgaggagaaa

SEQ ID NO: 679 - DNA, 2847 bp, Escherichia coli
gacggtcagagccgtattcaaatgcttgctaacggtaatgagcaaaagccgctggtgctgtctctgcgcgacgccgagggccagccagtcacgggcatgaaagatcagatcaagactgaactaaccttcaaaccggctggaaatattgtgactcgtaccctgaaggccactaaatcacaggcaaagccaacactgggtgagttcaccgaaactgaagcaggggtgtatcagtctgtctttactaccggaacgcagtcaggtgaggcaacgattactgttagcgttgatgacatgagcaaaactgtcactgcagaactgcgggccacgatgatggatgtgtcaaactccaccctgagtgctaacgagccgtcaggtgatgtggttgctgatggtcagcaagcctacacgctgacactgacagcggtggactccgagggtaatccggtgacgggagaagccagccgcctgcgacttgttccgcaagacactaatggtgtaaccgttggtgccatttcggaaataaaaccaggggtttacagcgccacggtttcttcgacccgtgccggaaacgttgttgtgcgtgccttcagcgagcagtatcagctgggcacattacaacaaacgctgaagtttgttgccgggccgcttgatgcagcacattcgtccatcacactgaatcctgataaaccggtggttggcggtacagttacggcaatctggacggcaaaagatgctaatgacaaccctgtaactggcctcaatccggatgcaccgtcattatcgggcgcagctgctgctggttctacggcatcaggctggacggataatggcgacgggacctggactgcgcagatttctctcggcactacggcgggtgaattagacgttatgccgaagctcaatgggcaggacgcggcagcaaatgcggcaaaagtaaccgtggtggctgatgcattatcttcaaaccagtcgaaagtctctgtcgcagaagatcacgtaaaagccggtgaaagcacaaccgtaacgctggtggcgaaagatgcgcatggcaacgctatcagtggtctttcgttgtcggcaagtttgacggggaccgcctctgaaggggcgaccgtttccagttggaccgaaaaaggtgacggttcctatgttgctacgttaactacaggcggaaagacgggcgagcttcgtgtcatgccgctcttcaacggccagcctgcagccaccgaagccgcgcagctgactgttattgccggagagatgtcatcagcgaactctacgcttgttgcggacaataaaactccaacggttaaaacgacgacggaactcaccttcaccatgaaggatgcgtacgggaatccggtcaccgggctgaagccagatgcaccagtgtttagtggtgccgccagcacggggagtgagcgtccttcagcaggaaactggacagagaaaggtaatggggtctacgtgtcgaccttaacgctgggatctgccgcgggtcagttgtctgtgatgccgcgagtgaacggccaaaatgccgttgctcagccactggtgctgaatgttgcaggtgacgcatctaaggctgagattcgtgatatgacagtgaaggttaataaccaactggctaatggacagtctgctaaccagatcaccctgaccgtcgtggacagctatggtaacccgttgcaggggcaagaagttacgctgactttaccgcagggtgtgaccagcaagacggggaatacagtaacaaccaatgcggcagggaaagtggacattgagcttatgtcaacggttgcaggggaacttgagatcgaggcctcggtgaaaaactctcagaagacggtcaaggtgaaattcaaggcggatttcagtaccggtcaggcgagcctggaggtagacgccgctgctcaaaaagtggcaaacggcaaagatgcctttacgctgacggcaacggttaaggatcaatacggcaaccttcttcctggcgctgtggtcgtctttaatctgcctcggggcgtcaaaccgcttgcagacggtaatatcatggtgaacgccgacaaggagggtaaagcggaactgaaagtggtttccgtgactgccggaacctatgagatcacggcgtcagcaggaaatgaccagccttcgaatgcgcagtctgtaacgtttgtggctgataagactacggcgaccatctccagtattgaggtgattggcaaccgtgcagtggcggacggcaaaaccaaacagacgtataaagttacggtgactgatgccaataacaacctgctgaaagatagcgaagtgacgctgactgccagcccggaaaatttagttctgactcccaatgggacggcgacaacgaatgagcaagggcaggctattttcaccgccacgaccactgtcgcagcgacatatacactcacggcgaaagtggaacaggccgacggtcaggaatcgacgaaaactgccgaatctaaattcgtcgcggatgataaaaacgcggtgctcgctgcatctccagagcgtgtagattctctggtggcggacgggaagactactgcaacactgacggttactctgatgtcgggtgtcaaccccgtaggaggaaccatgtgggtcgacattgaggctccggaaggggtgacagaggcggattatcagttcctgccgtcgaaaaatgaccatttcgcgagcgggaaaatcacgcgtacatttagtaccaacaagccaggtacatacacattcacattcaactctttgacatatggagggtatgaaatgaaaccagtgactgtgacaattaacgccgttcctgcagatactgaaggcgctgaggagaaa

SEQ ID NO: 680 - protein, 988 aa, Escherichia coli
CVAWANISVQVLFPLAVTFTPVMAARAQHAVQPRLSMENTTVTADNNVEKNVASLAANAGTFLSSQPDSDATRNFITGMATAKANQEIQEWLGKYGTARVKLNVDKNFSLKDSSLEMLYPIYDTPTNMLFTQGAIHRTDDRTQSNIGFGWRHFSENDWMAGVNTFIDHDLSRSHTRIGVGAEYWRDYLKLSANGYIRASGWKKSPDVEDYQERPANGWDIRAEGYLPAWPQLGASLMYEQYYGDEVGLFGKDKRQKDPHAITAEVNYTPVPLLTLSAGHKQGKSGENDTRFGLEVNYRIGEPLEKQLDTDSIRERRMLAGSRYDLVERNNNIVLEYRKSEVIRIALPERIEGKGGQTVSLGLVVSKATHGLKNVQWEAPSLLAAGGKITGQGNQWQVTLPAYQAGKDNYYAISAIAYDNKGNASKRVQTEVVISGAGMSADRTALTLDGQSRIQMLANGNEQKPLVLSLRDAEGQPVTGMKDQIKTELTFKPAGNIVTRTLKATKSQAKPTLGEFTETEAGVYQSVFTTGTQSGEATITVSVDDMSKTVTAELRATMMDVSNSTLSANEPSGDVVADGQQAYTLTLTAVDSEGNPVTGEASRLRLVPQDTNGVTVGAISEIKPGVYSATVSSTRAGNVVVRAFSEQYQLGTLQQTLKFVAGPLDAAHSSITLNPDKPVVGGTVTAIWTAKDANDNPVTGLNPDAPSLSGAAAAGSTASGWTDNGDGTWTAQISLGTTAGELDVMPKLNGQDAAANAAKVTVVADALSSNQSKVSVAEDHVKAGESTTVTLVAKDAHGNAISGLSLSASLTGTASEGATVSSWTEKGDGSYVATLTTGGKTGELRVMPLFNGQPAATEAAQLTVIAGEMSSANSTLVADNKTPTVKTTTELTFTMKDAYGNPVTGLKPDAPVFSGAASTGSERPSAGNWTEKGNGVYVSTLTLGSAAGQLSVMPRVNGQNAVAQPLVLNVAGDASKAEIRDMTVKVNNQ

SEQ ID NO: 681 - protein, 408 aa, Escherichia coli
LANGQSANQITLTVVDSYGNPLQGQEVTLTLPQGVTSKTGNTVTTNAAGKVDIELMSTVAGELEIEASVKNSQKTVKVKFKADFSTGQASLEVDAAAQKVANGKDAFTLTATVKDQYGNLLPGAVVVFNLPRGVKPLADGNIMVNADKEGKAELKVVSVTAGTYEITASAGNDQPSNAQSVTFVADKTTATISSIEVIGNRAVADGKTKQTYKVTVTDANNNLLKDSEVTLTASPENLVLTPNGTATTNEQGQAIFTATTTVAATYTLTAKVEQADGQESTKTAESKFVADDKNAVLAASPERVDSLVADGKTTATLTVTLMSGVNPVGGTMWVDIEAPEGVTEADYQFLPSKNDHFASGKITRTFSTNKPGTYTFTFNSLTYGGYEMKPVTVTINAVPADTEGAEEK

SEQ ID NO: 682 - protein, 949 aa, Escherichia coli
DGQSRIQMLANGNEQKPLVLSLRDAEGQPVTGMKDQIKTELTFKPAGNIVTRTLKATKSQAKPTLGEFTETEAGVYQSVFTTGTQSGEATITVSVDDMSKTVTAELRATMMDVSNSTLSANEPSGDVVADGQQAYTLTLTAVDSEGNPVTGEASRLRLVPQDTNGVTVGAISEIKPGVYSATVSSTRAGNVVVRAFSEQYQLGTLQQTLKFVAGPLDAAHSSITLNPDKPVVGGTVTAIWTAKDANDNPVTGLNPDAPSLSGAAAAGSTASGWTDNGDGTWTAQISLGTTAGELDVMPKLNGQDAAANAAKVTVVADALSSNQSKVSVAEDHVKAGESTTVTLVAKDAHGNAISGLSLSASLTGTASEGATVSSWTEKGDGSYVATLTTGGKTGELRVMPLFNGQPAATEAAQLTVIAGEMSSANSTLVADNKTPTVKTTTELTFTMKDAYGNPVTGLKPDAPVFSGAASTGSERPSAGNWTEKGNGVYVSTLTLGSAAGQLSVMPRVNGQNAVAQPLVLNVAGDASKAEIRDMTVKVNNQLANGQSANQITLTVVDSYGNPLQGQEVTLTLPQGVTSKTGNTVTTNAAGKVDIELMSTVAGELEIEASVKNSQKTVKVKFKADFSTGQASLEVDAAAQKVANGKDAFTLTATVKDQYGNLLPGAVVVFNLPRGVKPLADGNIMVNADKEGKAELKVVSVTAGTYEITASAGNDQPSNAQSVTFVADKTTATISSIEVIGNRAVADGKTKQTYKVTVTDANNNLLKDSEVTLTASPENLVLTPNGTATTNEQGQAIFTATTTVAATYTLTAKVEQADGQESTKTAESKFVADDKNAVLAASPERVDSLVADGKTTATLTVTLMSGVNPVGGTMWVDIEAPEGVTEADYQFLPSKNDHFASGKITRTFSTNKPGTYTFTFNSLTYGGYEMKPVTVTINAVPADTEGAEEK

SEQ ID NO: 683 - protein, 51 aa, Escherichia coli
AANAGTFLSSQPDSDATRNFITGMATAKANQEIQEWLGKYGTARVKLNVDK

SEQ ID NO: 684 - DNA, 26 bp, Artificial Sequence
  Synthetic oligonucleotide
  modified_base 1, 3, 5, 7, 9, 11, 13, 15, 17, 19, 21, 23, 25: 'n' is 'i' (Inosine)
ncncncncncncncncncncncncnc

SEQ ID NO: 685 - protein, 11 aa, Artificial Sequence
  Synthetic oligopeptide
KLKLLLLLKLK

The invention claimed is:

1. A composition comprising an immunologically effective amount of an adjuvant in admixture with an isolated or recombinant polypeptide fragment comprising amino acids of any one of the polypeptides of SEQ ID NOs: 3-18 and lacking amino acid residues 21-593 and 1009 to 1416, 1417, or 1418 of the applicable polypeptide of SEQ ID NO:3, 4, 5, 8, 9, 10, 11, 12, 13, 14, 15, 16, 17 or 18 or lacking amino acid residues 21-593 and 1009 to 1415 of SEQ ID NO: 6 or 7.

2. The composition of claim 1 wherein the fragment consists of amino acids 595-1008 of SEQ ID NOs: 3-18.

3. The composition of claim 1, wherein the fragment comprises amino acids of the polypeptide of SEQ ID NO:3 and lacking amino acid residues 21-593 and 1009 to 1418 of the polypeptide of SEQ ID NO:3.

4. The composition of claim 1, wherein the fragment comprises amino acids of SEQ ID NO:4 and lacking amino acid residues 21-593 and 1009 to 1418 of the polypeptide of SEQ ID NO:4.

5. The composition of claim 1, wherein the fragment comprises amino acids of SEQ ID NO:5 and lacking amino acid residues 21-593 and 1009 to 1418 of the polypeptide of SEQ ID NO:5.

6. The composition of claim 1, wherein the fragment comprises amino acids of SEQ ID NO:6 and lacking amino acid residues 21-593 and 1009 to 1415 of the polypeptide of SEQ ID NO:6.

7. The composition of claim 1, wherein the fragment comprises amino acids of SEQ ID NO:7 and lacking amino acid residues 21-593 and 1009 to 1415 of the polypeptide of SEQ ID NO:7.

8. The composition of claim 1, wherein the fragment comprises amino acids of SEQ ID NO:8 and lacking amino acid residues 21-593 and 1009 to 1416 of the polypeptide of SEQ ID NO:8.

9. The composition of claim 1, wherein the fragment comprises amino acids of SEQ ID NO:9 and lacking amino acid residues 21-593 and 1009 to 1416 of the polypeptide of SEQ ID NO:9.

10. The composition of claim 1, wherein the fragment comprises amino acids of SEQ ID NO:10 and lacking amino acid residues 21-593 and 1009 to 1416 of the polypeptide of SEQ ID NO:10.

11. The composition of claim 1, wherein the fragment comprises amino acids of SEQ ID NO:11 and lacking amino acid residues 21-593 and 1009 to 1417 of the polypeptide of SEQ ID NO:11.

12. The composition of claim 1, wherein the fragment comprises amino acids of SEQ ID NO:12 and lacking amino acid residues 21-593 and 1009 to 1417 of the polypeptide of SEQ ID NO:12.

13. The composition of claim 1, wherein the fragment comprises amino acids of SEQ ID NO:13 and lacking amino acid residues 21-593 and 1009 to 1417 of the polypeptide of SEQ ID NO:13.

14. The composition of claim 1, wherein the fragment comprises amino acids of SEQ ID NO:14 and lacking amino acid residues 21-593 and 1009 to 1417 of the polypeptide of SEQ ID NO:14.

15. The composition of claim 1, wherein the fragment comprises amino acids of SEQ ID NO:15 and lacking amino acid residues 21-593 and 1009 to 1417 of the polypeptide of SEQ ID NO:15.

16. The composition of claim 1, wherein the fragment comprises amino acids of SEQ ID NO:16 and lacking amino acid residues 21-593 and 1009 to 1417 of the polypeptide of SEQ ID NO:16.

17. The composition of claim 1, wherein the fragment comprises amino acids of SEQ ID NO:17 and lacking amino acid residues 21-593 and 1009 to 1417 of the polypeptide of SEQ ID NO:17.

18. The composition of claim 1, wherein the fragment comprises amino acids of SEQ ID NO:18 and lacking amino acid residues 21-593 and 1009 to 1417 of the polypeptide of SEQ ID NO:18.

\* \* \* \* \*

UNITED STATES PATENT AND TRADEMARK OFFICE
CERTIFICATE OF CORRECTION

PATENT NO. : 10,988,511 B2  
APPLICATION NO. : 13/382906  
DATED : April 27, 2021  
INVENTOR(S) : Serino et al.

Page 1 of 1

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 908 days.

Signed and Sealed this  
Twenty-second Day of February, 2022

Drew Hirshfeld  
*Performing the Functions and Duties of the*  
*Under Secretary of Commerce for Intellectual Property and*  
*Director of the United States Patent and Trademark Office*